(12) United States Patent
Yu et al.

(10) Patent No.: US 11,926,672 B2
(45) Date of Patent: Mar. 12, 2024

(54) MESOTHELIN-TARGETED CD40 AGONISTIC MULTISPECIFIC ANTIBODY CONSTRUCTS FOR THE TREATMENT OF SOLID TUMORS

(71) Applicant: Amgen Inc., Thousand Oaks, CA (US)

(72) Inventors: Xin Yu, Foster City, CA (US); Jackson Egen, San Mateo, CA (US); Fernando Garces, Sherman Oaks, CA (US); Shunsuke Takenaka, Vancouver (CA); AeRyon Kim, Foster City, CA (US); Deepali Sawant, Newark, CA (US)

(73) Assignee: Amgen Inc., Thousand Oaks, CA (US)

( * ) Notice: Subject to any disclaimer, the term of this patent is extended or adjusted under 35 U.S.C. 154(b) by 278 days.

(21) Appl. No.: 17/127,629

(22) Filed: Dec. 18, 2020

(65) Prior Publication Data

US 2021/0347905 A1 Nov. 11, 2021

Related U.S. Application Data

(60) Provisional application No. 62/951,408, filed on Dec. 20, 2019.

(51) Int. Cl.
| | |
|---|---|
| C07K 16/28 | (2006.01) |
| A61P 35/04 | (2006.01) |
| C07K 16/30 | (2006.01) |
| A61K 39/00 | (2006.01) |

(52) U.S. Cl.
CPC .......... *C07K 16/2878* (2013.01); *A61P 35/04* (2018.01); *C07K 16/30* (2013.01); *A61K 2039/505* (2013.01); *C07K 2317/31* (2013.01); *C07K 2317/33* (2013.01); *C07K 2317/35* (2013.01); *C07K 2317/522* (2013.01); *C07K 2317/524* (2013.01); *C07K 2317/526* (2013.01); *C07K 2317/53* (2013.01); *C07K 2317/565* (2013.01); *C07K 2317/622* (2013.01); *C07K 2317/75* (2013.01); *C07K 2317/92* (2013.01)

(58) Field of Classification Search
CPC .............. A61P 35/04; C07K 2317/565; C07K 2317/75; A61K 2039/505
See application file for complete search history.

(56) References Cited

U.S. PATENT DOCUMENTS

| | | | |
|---|---|---|---|
| 5,874,082 A | 2/1999 | De Boer | |
| 7,172,759 B2 | 2/2007 | Thomas | |
| 7,288,251 B2 | 10/2007 | Bedian | |
| 7,368,110 B2 | 5/2008 | Pastan | |
| 8,637,032 B2 | 1/2014 | Long | |
| 9,562,104 B2 * | 2/2017 | Banchereau | ............ A61P 35/02 |
| 10,233,258 B2 | 3/2019 | Akamatsu | |
| 10,449,227 B2 | 10/2019 | McLaughlin | |
| 2016/0376371 A1 | 12/2016 | Ravetch | |
| 2017/0355756 A1 * | 12/2017 | Julien | ..................... A61P 25/00 |
| 2022/0259328 A1 | 8/2022 | Tezuka | |

FOREIGN PATENT DOCUMENTS

| | | | | |
|---|---|---|---|---|
| EP | 3464367 B1 | 9/2020 | | |
| WO | 2002011763 A1 | 2/2002 | | |
| WO | 2004099249 A2 | 11/2004 | | |
| WO | 2006099141 A2 | 9/2006 | | |
| WO | WO-2008068048 A2 * | 6/2008 | ............. | A61P 31/10 |
| WO | 2009045957 A1 | 4/2009 | | |
| WO | 2009068204 A1 | 6/2009 | | |
| WO | 2012087962 A2 | 6/2012 | | |
| WO | 2012145673 A1 | 10/2012 | | |
| WO | 2013093809 A1 | 6/2013 | | |
| WO | 2014004549 A2 | 1/2014 | | |
| WO | 2014065402 A1 | 5/2014 | | |
| WO | 2014065403 A1 | 5/2014 | | |
| WO | 2015091853 A2 | 6/2015 | | |
| WO | 2016028810 A1 | 2/2016 | | |
| WO | 2016196314 A1 | 12/2016 | | |
| WO | 2017021356 A1 | 2/2017 | | |
| WO | 2017059243 A2 | 4/2017 | | |
| WO | 2017184619 A2 | 10/2017 | | |
| WO | 2017205738 A1 | 11/2017 | | |
| WO | 2018176159 A1 | 10/2018 | | |
| WO | 2018185045 A1 | 10/2018 | | |
| WO | 2020070035 A1 | 4/2020 | | |
| WO | 2020070041 A1 | 4/2020 | | |

OTHER PUBLICATIONS

Almagro JC, Fransson J. Humanization of antibodies. Front Biosci. Jan. 1, 2008;13:1619-33. (Year: 2008).*
Chen et al. Enhancement and destruction of antibody function by somatic mutation: unequal occurrence is controlled by V gene combinatorial associations.EMBO J.Jun. 15, 1995; 14(12): 2784-94. (Year: 1995).*
Kussie et al. A single engineered amino acid substitution changes antibody fine specificity.J Immunol. Jan. 1, 1994;152(1):146-52. (Year: 1994).*
Koenig et al. Mutational landscape of antibody variable domains reveals a switch modulating the interdomain conformational dynamics and antigen binding.PNAS Jan. 24, 2017 114(4)E486-E495;f irstpublished Jan. 5, 2017. (Year: 2017).*

(Continued)

*Primary Examiner* — Aurora M Fontainhas
*Assistant Examiner* — Jennifer A Benavides

(57) ABSTRACT

The present invention relates to a human agonistic CD40 multispecific antibody construct for treatment of solid tumors by engineering a molecule that specifically targets the CD40 pathway on tumor-associated APCs, without systemic CD40 activation.

35 Claims, 16 Drawing Sheets

Specification includes a Sequence Listing.

(56) References Cited

OTHER PUBLICATIONS

Beatty et al. (2017) Cancer immunotherapy: activating innate and adaptive immunity through CD40 agonists, Expert Review of Anticancer Therapy, 17:2, 175-186, DOI: 10.1080/14737140.2017.1270208.

International Search Report for PCT/US2020/066157, dated May 19, 2021.

* cited by examiner

| Antibody ID | CD40 Capture | | | | MSLN Capture | | | |
|---|---|---|---|---|---|---|---|---|
| | Half-life (h) | AUC last (hr*ug/mL) | Vss (mL/kg) | CL (mL/h/kg) | Half-life (h) | AUC last (hr*ug/mL) | Vss (mL/kg) | CL (mL/h/kg) |
| 8766-3 | 201 | 1108 | 174 | 0.61 | 197 | 993 | 192 | 0.7 |
| 6041-5 | 193 | 1998 | 95 | 0.36 | 216 | 1546 | 130 | 0.42 |
| 8765-3 | 269 | 2009 | 111 | 0.29 | 258 | 1812 | 120 | 0.33 |
| 8767-3 | 124 | 507 | 255 | 1.72 | 124 | 483 | 260 | 1.81 |
| 8945-3 | 115 | 1148 | 119 | 0.76 | 125 | 1206 | 123 | 0.7 |
| 8947-3 | 193 | 1998 | 95 | 0.36 | 199 | 2101 | 92 | 0.34 |

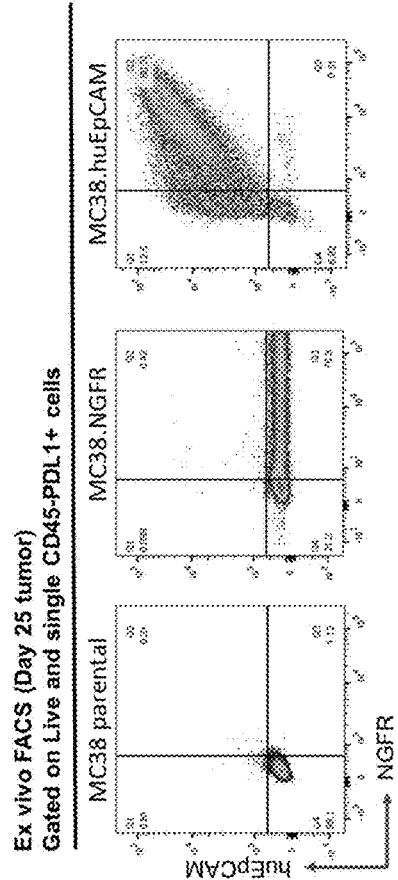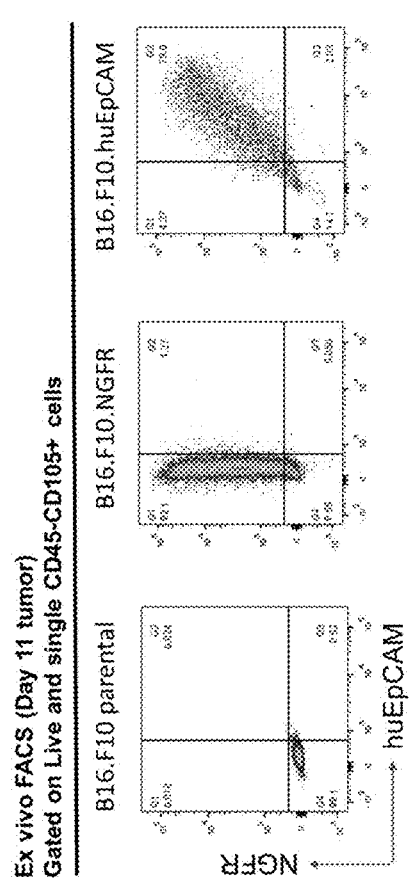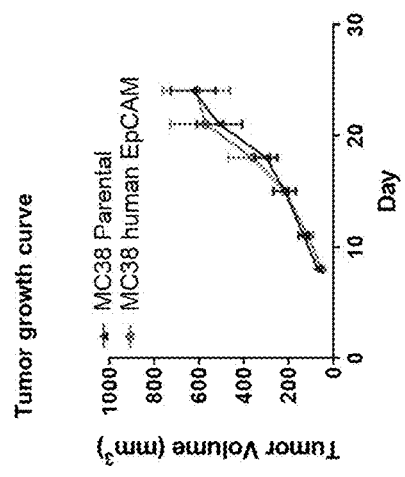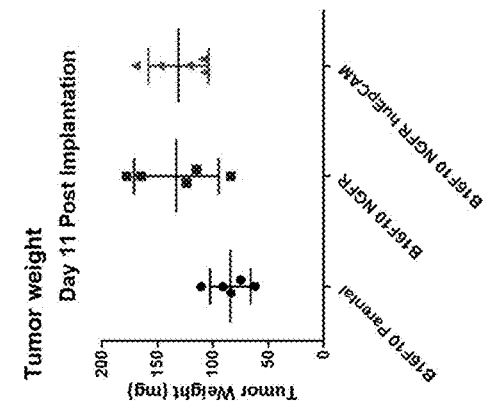

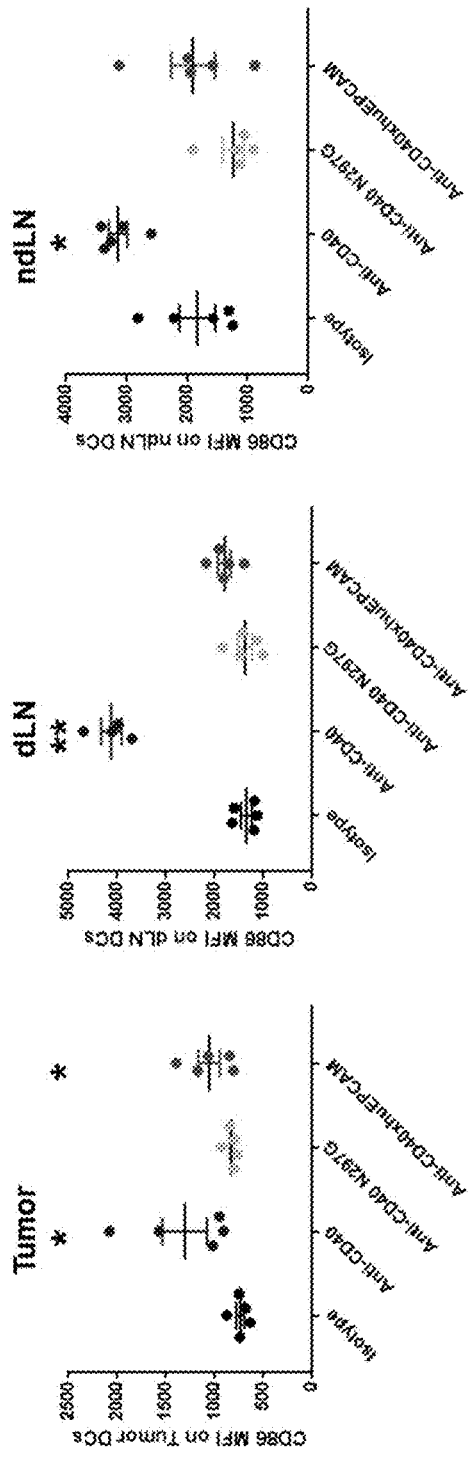
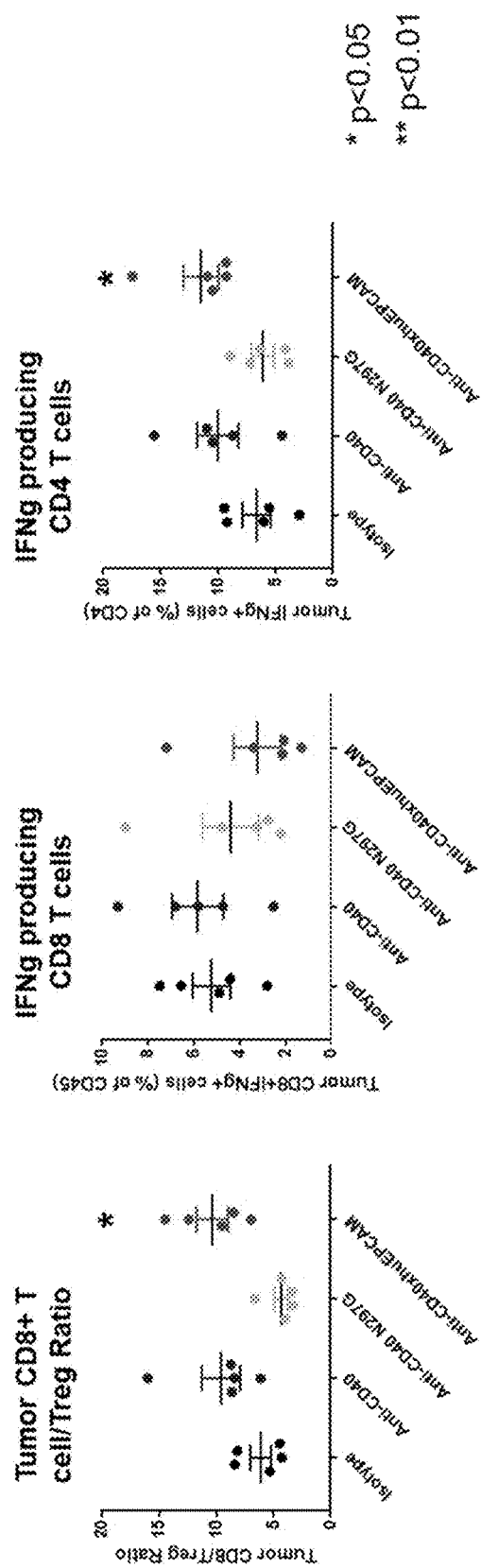
Fig. 8A
Fig. 8B

MESOTHELIN-TARGETED CD40 AGONISTIC MULTISPECIFIC ANTIBODY CONSTRUCTS FOR THE TREATMENT OF SOLID TUMORS

CROSS REFERENCE TO RELATED APPLICATIONS

This patent application claims the benefit of U.S. provisional application No. 62/951,408, filed Dec. 20, 2019, which is herein incorporated by reference in its entirety.

The present application is being filed along with a sequence listing in electronic format. The sequence listing is provided as a file entitled A-2428-US-NP_SeqList_121720_ST25, created Dec. 17, 2020, which is 1.67 MB in size. The information in the electronic format of the sequence listing is incorporated herein by reference in its entirety.

FIELD OF THE INVENTION

The present invention relates to the field of oncology, specifically cancer immunotherapy. The invention relates to a human agonistic CD40 antibody by engineering a molecule that specifically targets the CD40 pathway on tumor-associated APCs, without systemic CD40 activation.

BACKGROUND OF THE INVENTION

Treating cancer patients who do not respond to immune checkpoint inhibitors, such as anti-PD1, represent both the primary challenge and an exciting opportunity in the quickly changing landscape of immunotherapy. A major determinant of response to PD1 blockade in solid tumors is the degree of pre-treatment tumor-associated T cell infiltration, with patients having poorly infiltrated, 'cold' tumors showing minimum clinical benefit. While clinical data are still emerging, the clinical activity of other T cell-targeted immunotherapies beyond PD1 blockade, such as solid tumor BiTE® antibody constructs or CAR-T approaches, may also be limited in 'cold' tumors. Combining T cell-targeted approaches with new classes of therapeutics capable of enhancing T-cell infiltration into solid tumors may be critical for maximizing the number of patients benefiting from immunotherapy.

CD40 is a member of the TNF receptor (TNFR) superfamily that is preferentially expressed by antigen presenting cells (APCs), such as dendritic cells, B cells and macrophages. Interaction with its trimeric ligand on activated T helper cells results in APC activation that includes upregulation of cytokines/chemokines (such as interleukin-12 [IL-12] and CxCL10), proteins involved in antigen-presentation (such as MHC class I and II ligands), T cell costimulatory ligands (such as CD80 and CD86), and array of other immune modulatory factors (i.e., adhesion molecules and other TNFRs). These "licensed" APCs can then trigger a cascade of events leading to induction of robust adaptive immune responses.

Therapeutics capable of activating CD40 signaling have the potential to inflame solid tumors through their ability to enhance generation of anti-tumor T cells and enhance T cell recruitment directly into the tumor lesion. Preclinical studies with anti-CD40 agonists suggest that triggering CD40 with crosslinking antibodies on APCs can substitute for CD4 T cell help to license APCs and facilitate the activation as well as expansion of CD8 effector T cells. In addition, CD40-activated macrophages may also exert direct tumoricidal functions. These anti-CD40 agonist antibodies have been demonstrated to be efficacious in multiple syngeneic tumor models alone or in combination with other therapies. Based on these pre-clinical studies several CD40 agonistic antibodies are under investigation in phase I/II clinical trials of solid tumor patients. To date, these monoclonal anti-CD40 antibodies have shown some signs of clinical activity, but are often associated with immune-related adverse effects, such as cytokine release syndrome and evidence of liver damage. These toxicities limit the dose of CD40 agonist that can be delivered, and thus may result in insufficient activation of the CD40 pathway in tumor-associated APC population, negatively impacting the efficacy of this therapeutic approach. Therapeutics capable of localizing activation of CD40 signaling in tumor tissue may improve anti-tumor effects while limiting systemic toxicities.

In order to achieve tumor localization, an agonistic multispecific antibody construct that binds both CD40 and a tumor-associated antigen (TAA), mesothelin (MSLN), was designed. Robust agonist activity of this multispecific antibody construct on CD40-expressing APCs is entirely dependent on the presence of neighboring MSLN-expressing cells. The multispecific antibody construct was specifically engineered to lack CD40 agonist activity upon binding to CD40 in the absence of MSLN-expressing cells. In addition, introduction of mutations into the IgG Fc domain limits binding to Fc receptors, thus preventing Fc receptor-mediated CD40 agonist activity. Thus, the MSLN-dependent CD40 agonist multispecific antibody construct described herein has the potential to drive robust CD40-mediated activation of APCs in a manner that is confined primarily to tumor tissue, thus minimizing induction of systemic toxicities.

SUMMARY OF THE INVENTION

The present invention is directed to a multispecific antibody construct comprising:

(i) a first antibody comprising two light chains and two heavy chains, wherein the light chains comprise a first variable region (VL1) and a light chain constant region (CL);

the heavy chains comprise a first heavy variable region (VH1) and CH1, hinge, CH2, and CH3 regions;

the heavy chains comprise at least one amino acid substitution that results in a reduced binding affinity of the heavy chain for human Fc gamma RI receptor as compared with an unsubstituted heavy chain; and (ii) a scFv comprising a second light chain variable region (VL2) and a second heavy chain variable region (VH2) of a second antibody, wherein the VL2 and the VH2 are connected via a first peptide linker, wherein the scFv is fused at its amino terminus to the carboxyl terminus of each of the heavy chains through a second peptide linker such that a heavy chain fusion protein is formed; and wherein the first antibody specifically binds to and agonizes human CD40 (SEQ ID NO: 1) and the scFv specifically binds to human mesothelin (MSLN) (SEQ ID NO: 2).

In one embodiment, the multispecific antibody construct specifically agonizes CD40 in a MSLN-dependent fashion.

In one embodiment, the multispecific antibody construct comprises mutations limiting Fc receptor binding and thus decreases Fc receptor-dependent CD40 agonism.

In one embodiment, the two light chains are identical and the two heavy chain fusion proteins are identical.

In one embodiment, the heavy chain comprises an amino acid substitution selected from the group consisting of:
(i) N297G or N297A;
(ii) L234A and L235A; and
(iii) R292C and V302C;
wherein the amino acid numbering is EU numbering according to Kabat.

In one embodiment, the heavy chain comprises N297G, R292C, and V302C mutations, wherein the amino acid numbering is EU numbering according to Kabat.

In one embodiment, the VL1 comprises a CDRL1, a CDRL2, and a CDRL3 selected from the group consisting of:
  SEQ ID NOs: 58, 59, and 60, respectively;
  SEQ ID NOs: 64, 65, and 66, respectively;
  SEQ ID NOs: 70, 71, and 72, respectively;
  SEQ ID NOs: 76, 77, and 78, respectively;
  SEQ ID NOs: 82, 83, and 84, respectively;
  SEQ ID NOs: 88, 89, and 90, respectively;
  SEQ ID NOs: 94, 95, and 96, respectively;
  SEQ ID NOs: 100, 101, and 102, respectively;
  SEQ ID NOs: 106, 107, and 108, respectively;
  SEQ ID NOs: 112, 113, and 114, respectively;
  SEQ ID NOs: 118, 119, and 120, respectively;
  SEQ ID NOs: 124, 125, and 126, respectively; and
  SEQ ID NOs: 130, 131, and 132, respectively;
the VH1 comprises a CDRH1, a CDRH2, and a CDRH3 selected from the group consisting of:
  SEQ ID NOs: 136, 137, and 138, respectively;
  SEQ ID NOs: 142, 143, and 144, respectively;
  SEQ ID NOs: 148, 149, and 150, respectively;
  SEQ ID NOs: 154, 155, and 156, respectively;
  SEQ ID NOs: 160, 161, and 162, respectively;
  SEQ ID NOs: 166, 167, and 168, respectively;
  SEQ ID NOs: 172, 173, and 174, respectively;
  SEQ ID NOs: 178, 179, and 180, respectively;
  SEQ ID NOs: 184, 185, and 186, respectively;
  SEQ ID NOs: 190, 191, and 192, respectively;
  SEQ ID NOs: 196, 197, and 198, respectively;
  SEQ ID NOs: 202, 203, and 204, respectively; and
  SEQ ID NOs: 208, 209, and 210, respectively;
the VL2 comprises a CDRL1, a CDRL2, and a CDRL3 selected from the group consisting of:
  SEQ ID NOs: 230, 231, and 232, respectively;
  SEQ ID NOs: 236, 237, and 238, respectively;
  SEQ ID NOs: 242, 243, and 244, respectively; and
  SEQ ID NOs: 248, 249, and 250, respectively;
and the VH2 comprises a CDRH1, a CDRH2, and a CDRH3 selected from the group consisting of:
  SEQ ID NOs: 254, 255, and 256, respectively;
  SEQ ID NOs: 260, 261, and 262, respectively;
  SEQ ID NOs: 266, 267, and 268, respectively; and
  SEQ ID NOs: 272, 273, and 274, respectively.

In one embodiment, 1) the VL1 and VH1 are selected from the group consisting of:
a) a VL1 comprising a CDRL1, a CDRL2, and a CDRL3 selected from the group consisting of SEQ ID NOs: 58, 59, and 60, respectively; and a VH1 comprising a CDRH1, a CDRH2, and a CDRH3 selected from the group consisting of SEQ ID NOs: 136, 137, and 138, respectively;
b) a VL1 comprising a CDRL1, a CDRL2, and a CDRL3 selected from the group consisting of SEQ ID NOs: 64, 65, and 66, respectively; and a VH1 comprising a CDRH1, a CDRH2, and a CDRH3 selected from the group consisting of SEQ ID NOs: 142, 143, and 144, respectively;
c) a VL1 comprising a CDRL1, a CDRL2, and a CDRL3 selected from the group consisting of SEQ ID NOs: 70, 71, and 72, respectively; and a VH1 comprising a CDRH1, a CDRH2, and a CDRH3 selected from the group consisting of SEQ ID NOs: 148, 149, and 150, respectively;
d) a VL1 comprising a CDRL1, a CDRL2, and a CDRL3 selected from the group consisting of SEQ ID NOs: 76, 77, and 6780, respectively; and a VH1 comprising a CDRH1, a CDRH2, and a CDRH3 selected from the group consisting of SEQ ID NOs: 154, 155, and 156, respectively;
e) a VL1 comprising a CDRL1, a CDRL2, and a CDRL3 selected from the group consisting of SEQ ID NOs: 82, 83, and 84, respectively; and a VH1 comprising a CDRH1, a CDRH2, and a CDRH3 selected from the group consisting of SEQ ID NOs: 160, 161, and 162, respectively;
f) a VL1 comprising a CDRL1, a CDRL2, and a CDRL3 selected from the group consisting of SEQ ID NOs: 88, 89, and 90, respectively; and a VH1 comprising a CDRH1, a CDRH2, and a CDRH3 selected from the group consisting of SEQ ID NOs: 166, 167, and 168, respectively;
g) a VL1 comprising a CDRL1, a CDRL2, and a CDRL3 selected from the group consisting of SEQ ID NOs: 94, 95, and 96, respectively; and a VH1 comprising a CDRH1, a CDRH2, and a CDRH3 selected from the group consisting of SEQ ID NOs: 172, 173, and 174, respectively;
h) a VL1 comprising a CDRL1, a CDRL2, and a CDRL3 selected from the group consisting of SEQ ID NOs: 100, 101, and 102, respectively; and a VH1 comprising a CDRH1, a CDRH2, and a CDRH3 selected from the group consisting of SEQ ID NOs: 178, 179, and 180, respectively;
i) a VL1 comprising a CDRL1, a CDRL2, and a CDRL3 selected from the group consisting of SEQ ID NOs: 106, 107, and 108, respectively; and a VH1 comprising a CDRH1, a CDRH2, and a CDRH3 selected from the group consisting of SEQ ID NOs: 184, 185, and 186, respectively;
j) a VL1 comprising a CDRL1, a CDRL2, and a CDRL3 selected from the group consisting of SEQ ID NOs: 112, 113, and 114, respectively; and a VH1 comprising a CDRH1, a CDRH2, and a CDRH3 selected from the group consisting of SEQ ID NOs: 190, 191, and 192, respectively;
k) a VL1 comprising a CDRL1, a CDRL2, and a CDRL3 selected from the group consisting of SEQ ID NOs: 118, 119, and 120, respectively; and a VH1 comprising a CDRH1, a CDRH2, and a CDRH3 selected from the group consisting of SEQ ID NOs: 196, 197, and 198, respectively;
l) a VL1 comprising a CDRL1, a CDRL2, and a CDRL3 selected from the group consisting of SEQ ID NOs: 124, 125, and 126, respectively; and a VH1 comprising a CDRH1, a CDRH2, and a CDRH3 selected from the group consisting of SEQ ID NOs: 202, 203, and 204, respectively; and
m) a VL1 comprising a CDRL1, a CDRL2, and a CDRL3 selected from the group consisting of SEQ ID NOs: 130, 131, and 132, respectively; and a VH1 comprising a CDRH1, a CDRH2, and a CDRH3 selected from the group consisting of SEQ ID NOs: 208, 209, and 210, respectively;

and 2) the VL2 and VH2 are selected from the group consisting of:
- a) a VL2 comprising a CDRL1, a CDRL2, and a CDRL3 selected from the group consisting of SEQ ID NOs: 230, 231, and 232, respectively; and a VH2 comprising a CDRH1, a CDRH2, and a CDRH3 selected from the group consisting of SEQ ID NOs: 254, 255, and 256, respectively;
- b) a VL2 comprising a CDRL1, a CDRL2, and a CDRL3 selected from the group consisting of SEQ ID NOs: 236, 237, and 238, respectively; and a VH2 comprising a CDRH1, a CDRH2, and a CDRH3 selected from the group consisting of SEQ ID NOs: 260, 261, and 262, respectively;
- c) a VL2 comprising a CDRL1, a CDRL2, and a CDRL3 selected from the group consisting of SEQ ID NOs: 242, 243, and 244, respectively; and a VH2 comprising a CDRH1, a CDRH2, and a CDRH3 selected from the group consisting of SEQ ID NOs: 266, 267, and 268, respectively; and
- d) a VL2 comprising a CDRL1, a CDRL2, and a CDRL3 selected from the group consisting of SEQ ID NOs: 248, 249, and 250, respectively; and a VH2 comprising a CDRH1, a CDRH2, and a CDRH3 selected from the group consisting of SEQ ID NOs: 272, 273, and 274, respectively.

In one embodiment, the VL1 comprises an amino acid sequence selected from the group consisting of SEQ ID NOs: 5, 9, 13, 17, 21, 25, 29, 33, 37, 41, 45, 49, and 53;

the VH1 comprises an amino acid sequence selected from the group consisting of SEQ ID NO: 6, 10, 14, 18, 22, 26, 30, 34, 38, 42, 46, 50, and 54;

the VL2 comprises an amino acid sequence selected from the group consisting of SEQ ID NO: 213, 217, 221, and 225;

the VH2 comprises an amino acid sequence selected from the group consisting of SEQ ID NO: 214, 218, 222, and 226.

In one embodiment, 1) the VL1 and VH1 are selected from the group consisting of:
- a) a VL1 comprising SEQ ID NO: 5 and a VH1 comprising SEQ ID NO: 6;
- b) a VL1 comprising SEQ ID NO: 9 and a VH1 comprising SEQ ID NO: 10;
- c) a VL1 comprising SEQ ID NO: 13 and a VH1 comprising SEQ ID NO: 14;
- d) a VL1 comprising SEQ ID NO: 17 and a VH1 comprising SEQ ID NO: 18;
- e) a VL1 comprising SEQ ID NO: 21 and a VH1 comprising SEQ ID NO: 22;
- f) a VL1 comprising SEQ ID NO: 25 and a VH1 comprising SEQ ID NO: 26;
- g) a VL1 comprising SEQ ID NO: 29 and a VH1 comprising SEQ ID NO: 30;
- h) a VL1 comprising SEQ ID NO: 33 and a VH1 comprising SEQ ID NO: 34;
- i) a VL1 comprising SEQ ID NO: 37 and a VH1 comprising SEQ ID NO: 38;
- j) a VL1 comprising SEQ ID NO: 41 and a VH1 comprising SEQ ID NO: 42;
- k) a VL1 comprising SEQ ID NO: 45 and a VH1 comprising SEQ ID NO: 46;
- l) a VL1 comprising SEQ ID NO: 49 and a VH1 comprising SEQ ID NO: 50; and
- m) a VL1 comprising SEQ ID NO: 53 and a VH1 comprising SEQ ID NO: 54;

and 2) the VL2 and VH2 are selected from the group consisting of:
- a) a VL2 comprising SEQ ID NO: 213 and a VH2 comprising SEQ ID NO: 214;
- b) a VL2 comprising SEQ ID NO: 217 and a VH2 comprising SEQ ID NO: 218;
- c) a VL2 comprising SEQ ID NO: 221 and a VH2 comprising SEQ ID NO: 222; and
- d) a VL2 comprising SEQ ID NO: 225 and a VH2 comprising SEQ ID NO: 226.

In one embodiment, the CL of the light chain is selected from the group consisting of SEQ ID NO: 883 and SEQ ID NO: 884.

In one embodiment, the CH1-hinge-CH2-CH3 of the heavy chain is selected from the group consisting of SEQ ID NO: 885 and SEQ ID NO: 886.

In one embodiment, the first peptide linker is selected from the group consisting of SEQ ID NOs: 888-893.

In one embodiment, the second peptide linker is selected from the group consisting of SEQ ID NOs: 887-893.

In one embodiment, the first peptide linker comprises SEQ ID NO: 889 and the second peptide linker comprises SEQ ID NO: 887.

In one embodiment, the light chain comprises a sequence selected from the group consisting of SEQ ID NOs: 286, 290, 294, 298, 302, 306, 310, 314, 318, 322, 326, 330, 336, 342, 346, 350, 354, 358, 362, 366, 370, 374, and 378; and the heavy chain fusion protein comprises a sequence selected from the group consisting of SEQ ID Nos: 285, 289, 293, 297, 301, 305, 309, 313, 317, 321, 325, 329, 333, 337, 341, 345, 349, 353, 357, 361, 365, 369, 373, and 377.

In one embodiment, the light chain and the heavy chain fusion protein comprise polypeptides comprising amino acid sequences selected from the group consisting of:

SEQ ID NO: 286 and SEQ ID NO: 285, respectively;
SEQ ID NO: 290 and SEQ ID NO: 289, respectively;
SEQ ID NO: 294 and SEQ ID NO: 293, respectively;
SEQ ID NO: 298 and SEQ ID NO: 297, respectively;
SEQ ID NO: 302 and SEQ ID NO: 301, respectively;
SEQ ID NO: 306 and SEQ ID NO: 305, respectively;
SEQ ID NO: 310 and SEQ ID NO: 309, respectively;
SEQ ID NO: 314 and SEQ ID NO: 313, respectively;
SEQ ID NO: 318 and SEQ ID NO: 317, respectively;
SEQ ID NO: 322 and SEQ ID NO: 321, respectively;
SEQ ID NO: 326 and SEQ ID NO: 325, respectively;
SEQ ID NO: 330 and SEQ ID NO: 329, respectively;
SEQ ID NO: 334 and SEQ ID NO: 333, respectively;
SEQ ID NO: 338 and SEQ ID NO: 337, respectively;
SEQ ID NO: 342 and SEQ ID NO: 341, respectively;
SEQ ID NO: 346 and SEQ ID NO: 345, respectively;
SEQ ID NO: 350 and SEQ ID NO: 349, respectively;
SEQ ID NO: 354 and SEQ ID NO: 353, respectively;
SEQ ID NO: 358 and SEQ ID NO: 357, respectively;
SEQ ID NO: 362 and SEQ ID NO: 361, respectively;
SEQ ID NO: 366 and SEQ ID NO: 365, respectively;
SEQ ID NO: 370 and SEQ ID NO: 369, respectively;
SEQ ID NO: 374 and SEQ ID NO: 373, respectively; and
SEQ ID NO: 378 and SEQ ID NO: 377, respectively.

In one aspect, the present invention is directed to a polynucleotide encoding the light chain of the antibody construct of the present invention.

In one aspect, the present invention is directed to a polynucleotide encoding the heavy chain fusion protein of the antibody construct of the present invention.

In one aspect, the present invention is directed to a vector comprising the polynucleotide encoding the light chain of the antibody construct, the polynucleotide encoding the heavy chain of the antibody construct, or both.

In one aspect, the present invention is directed to a host cell transformed or transfected with the vector or the polynucleotide encoding the light chain of the antibody construct and the polynucleotide encoding the heavy chain of the antibody construct.

In one aspect, the present invention is directed to a process for producing the antibody construct of the present invention, the process comprising culturing a host cell comprising a polynucleotide encoding the light chain and also comprising a polynucleotide encoding the heavy chain fusion protein under conditions allowing the expression of the antibody construct, and recovering the produced antibody construct from the culture.

In one aspect, the present invention is directed to a pharmaceutical composition comprising the antibody construct according to the present invention and a carrier, stabilizer, excipient, diluent, solubilizer, surfactant, emulsifier, preservative or adjuvant.

In one aspect, the present invention is directed to a method for treating or ameliorating a solid tumor disease or a metastatic cancer disease, comprising the step of administering to a subject in need thereof an effective amount of the antibody construct according to the present invention.

In one embodiment, the solid tumor disease is selected from the group consisting of: ovarian cancer, pancreatic cancer, mesothelioma, lung cancer, gastric cancer and triple negative breast cancer disease or a metastatic cancer disease derived from any of the foregoing.

In one aspect, the present invention is directed to a kit comprising the antibody construct according to the present invention and, optionally, directions for use.

In one aspect, the present invention is directed to a multispecific antibody construct comprising:

(i) a first antibody comprising two light chains and two heavy chains, wherein the light chains comprise a first variable region (VL1) and a light chain constant region (CL);

the heavy chains comprise a first heavy variable region (VH1) and CH1, hinge, CH2, and CH3 regions;

the heavy chains comprise at least one amino acid substitution that results in a reduced binding affinity of the heavy chain for human Fc gamma RI receptor as compared with an unsubstituted heavy chain; and (ii) a scFv comprising a second light chain variable region (VL2) and a second heavy chain variable region (VH2) of a second antibody, wherein the VL2 and the VH2 are connected via a first peptide linker, wherein the scFv is fused at its amino terminus to the carboxyl terminus of each of the heavy chains through a second peptide linker such that a heavy chain fusion protein is formed; and wherein the first antibody specifically binds to human mesothelin (MSLN) (SEQ ID NO: 2) and the scFv specifically binds to and agonizes human CD40 (SEQ ID NO: 1).

In one embodiment, the multispecific antibody construct specifically agonizes CD40 in a MSLN-dependent fashion.

In one embodiment, the multispecific antibody construct comprises mutations limiting Fc receptor binding and thus decreases Fc receptor-dependent CD40 agonism.

In one embodiment, the two light chains are identical and the two heavy chain fusion proteins are identical.

In one embodiment, the heavy chain comprises an amino acid substitution selected from the group consisting of:
(i) N297G or N297A;
(ii) L234A and L235A; and
(iii) R292C and V302C;
wherein the amino acid numbering is EU numbering according to Kabat.

In one embodiment, the heavy chain comprises N297G, R292C, and V302C mutations, wherein the amino acid numbering is EU numbering according to Kabat.

In one embodiment:
the VL1 comprises a CDRL1, a CDRL2, and a CDRL3 selected from the group consisting of:
 SEQ ID NOs: 230, 231, and 232, respectively;
 SEQ ID NOs: 236, 237, and 238, respectively;
 SEQ ID NOs: 242, 243, and 244, respectively; and
 SEQ ID NOs: 248, 249, and 250, respectively;
the VH1 comprises a CDRH1, a CDRH2, and a CDRH3 selected from the group consisting of:
 SEQ ID NOs: 254, 255, and 256, respectively;
 SEQ ID NOs: 260, 261, and 262, respectively;
 SEQ ID NOs: 266, 267, and 268, respectively; and
 SEQ ID NOs: 272, 273, and 274, respectively;
the VL2 comprises a CDRL1, a CDRL2, and a CDRL3 selected from the group consisting of:
 SEQ ID NOs: 58, 59, and 60, respectively;
 SEQ ID NOs: 64, 65, and 66, respectively;
 SEQ ID NOs: 70, 71, and 72, respectively;
 SEQ ID NOs: 76, 77, and 78, respectively;
 SEQ ID NOs: 82, 83, and 84, respectively;
 SEQ ID NOs: 88, 89, and 90, respectively;
 SEQ ID NOs: 94, 95, and 96, respectively;
 SEQ ID NOs: 100, 101, and 102, respectively;
 SEQ ID NOs: 106, 107, and 108, respectively;
 SEQ ID NOs: 112, 113, and 114, respectively;
 SEQ ID NOs: 118, 119, and 120, respectively;
 SEQ ID NOs: 124, 125, and 126, respectively; and
 SEQ ID NOs: 130, 131, and 132, respectively;
and
the VH2 comprises a CDRH1, a CDRH2, and a CDRH3 selected from the group consisting of:
 SEQ ID NOs: 136, 137, and 138, respectively;
 SEQ ID NOs: 142, 143, and 144, respectively;
 SEQ ID NOs: 148, 149, and 150, respectively;
 SEQ ID NOs: 154, 155, and 156, respectively;
 SEQ ID NOs: 160, 161, and 162, respectively;
 SEQ ID NOs: 166, 167, and 168, respectively;
 SEQ ID NOs: 172, 173, and 174, respectively;
 SEQ ID NOs: 178, 179, and 180, respectively;
 SEQ ID NOs: 184, 185, and 186, respectively;
 SEQ ID NOs: 190, 191, and 192, respectively;
 SEQ ID NOs: 196, 197, and 198, respectively;
 SEQ ID NOs: 202, 203, and 204, respectively; and
 SEQ ID NOs: 208, 209, and 210, respectively.
In one embodiment,
1) the VL1 and VH1 are selected from the group consisting of:
 a) a VL1 comprising a CDRL1, a CDRL2, and a CDRL3 selected from the group consisting of SEQ ID NOs: 230, 231, and 232, respectively; and a VH1 comprising a CDRH1, a CDRH2, and a CDRH3 selected from the group consisting of SEQ ID NOs: 254, 255, and 256, respectively;
 b) a VL1 comprising a CDRL1, a CDRL2, and a CDRL3 selected from the group consisting of SEQ ID NOs: 236, 237, and 238, respectively; and a VH1 comprising a CDRH1, a CDRH2, and a CDRH3 selected from the group consisting of SEQ ID NOs: 260, 261, and 262, respectively;
c) a VL1 comprising a CDRL1, a CDRL2, and a CDRL3 selected from the group consisting of SEQ ID NOs: 242, 243, and 244, respectively; and a VH1 comprising a CDRH1, a CDRH2, and a CDRH3 selected from the group consisting of SEQ ID NOs: 266, 267, and 268, respectively; and
d) a VL1 comprising a CDRL1, a CDRL2, and a CDRL3 selected from the group consisting of SEQ ID NOs: 248, 249, and 250, respectively; and a VH1 comprising a CDRH1, a CDRH2, and a CDRH3 selected from the group consisting of SEQ ID NOs: 272, 273, and 274, respectively;

and 2) the VL2 and VH2 are selected from the group consisting of:
a) a VL2 comprising a CDRL1, a CDRL2, and a CDRL3 selected from the group consisting of SEQ ID NOs: 58, 59, and 60, respectively; and a VH2 comprising a CDRH1, a CDRH2, and a CDRH3 selected from the group consisting of SEQ ID NOs: 136, 137, and 138, respectively;
b) a VL2 comprising a CDRL1, a CDRL2, and a CDRL3 selected from the group consisting of SEQ ID NOs: 64, 65, and 66, respectively; and a VH2 comprising a CDRH1, a CDRH2, and a CDRH3 selected from the group consisting of SEQ ID NOs: 142, 143, and 144, respectively;
c) a VL2 comprising a CDRL1, a CDRL2, and a CDRL3 selected from the group consisting of SEQ ID NOs: 70, 71, and 72, respectively; and a VH2 comprising a CDRH1, a CDRH2, and a CDRH3 selected from the group consisting of SEQ ID NOs: 148, 149, and 150, respectively;
d) a VL2 comprising a CDRL1, a CDRL2, and a CDRL3 selected from the group consisting of SEQ ID NOs: 76, 77, and 6780, respectively; and a VH2 comprising a CDRH1, a CDRH2, and a CDRH3 selected from the group consisting of SEQ ID NOs: 154, 155, and 156, respectively;
e) a VL2 comprising a CDRL1, a CDRL2, and a CDRL3 selected from the group consisting of SEQ ID NOs: 82, 83, and 84, respectively; and a VH2 comprising a CDRH1, a CDRH2, and a CDRH3 selected from the group consisting of SEQ ID NOs: 160, 161, and 162, respectively;
f) a VL2 comprising a CDRL1, a CDRL2, and a CDRL3 selected from the group consisting of SEQ ID NOs: 88, 89, and 90, respectively; and a VH2 comprising a CDRH1, a CDRH2, and a CDRH3 selected from the group consisting of SEQ ID NOs: 166, 167, and 168, respectively;
g) a VL2 comprising a CDRL1, a CDRL2, and a CDRL3 selected from the group consisting of SEQ ID NOs: 94, 95, and 96, respectively; and a VH2 comprising a CDRH1, a CDRH2, and a CDRH3 selected from the group consisting of SEQ ID NOs: 172, 173, and 174, respectively;
h) a VL2 comprising a CDRL1, a CDRL2, and a CDRL3 selected from the group consisting of SEQ ID NOs: 100, 101, and 102, respectively; and a VH2 comprising a CDRH1, a CDRH2, and a CDRH3 selected from the group consisting of SEQ ID NOs: 178, 179, and 180, respectively;
i) a VL2 comprising a CDRL1, a CDRL2, and a CDRL3 selected from the group consisting of SEQ ID NOs: 106, 107, and 108, respectively; and a VH2 comprising a CDRH1, a CDRH2, and a CDRH3 selected from the group consisting of SEQ ID NOs: 184, 185, and 186, respectively;
j) a VL2 comprising a CDRL1, a CDRL2, and a CDRL3 selected from the group consisting of SEQ ID NOs: 112, 113, and 114, respectively; and a VH2 comprising a CDRH1, a CDRH2, and a CDRH3 selected from the group consisting of SEQ ID NOs: 190, 191, and 192, respectively;
k) a VL2 comprising a CDRL1, a CDRL2, and a CDRL3 selected from the group consisting of SEQ ID NOs: 118, 119, and 120, respectively; and a VH2 comprising a CDRH1, a CDRH2, and a CDRH3 selected from the group consisting of SEQ ID NOs: 196, 197, and 198, respectively;
l) a VL2 comprising a CDRL1, a CDRL2, and a CDRL3 selected from the group consisting of SEQ ID NOs: 124, 125, and 126, respectively; and a VH2 comprising a CDRH1, a CDRH2, and a CDRH3 selected from the group consisting of SEQ ID NOs: 202, 203, and 204, respectively; and
m) a VL2 comprising a CDRL1, a CDRL2, and a CDRL3 selected from the group consisting of SEQ ID NOs: 130, 131, and 132, respectively; and a VH2 comprising a CDRH1, a CDRH2, and a CDRH3 selected from the group consisting of SEQ ID NOs: 208, 209, and 210, respectively.

In one embodiment:
the VL1 comprises an amino acid sequence selected from the group consisting of SEQ ID NO: 213, 217, 221, and 225;
the VH1 comprises an amino acid sequence selected from the group consisting of SEQ ID NO: 214, 218, 222, and 226;
the VL2 comprises an amino acid sequence selected from the group consisting of SEQ ID NOs: 5, 9, 13, 17, 21, 25, 29, 33, 37, 41, 45, 49, and 53; and
the VH2 comprises an amino acid sequence selected from the group consisting of SEQ ID NO: 6, 10, 14, 18, 22, 26, 30, 34, 38, 42, 46, 50, and 54.

In one embodiment:
1) the VL1 and VH1 are selected from the group consisting of:
a) a VL1 comprising SEQ ID NO: 213 and a VH1 comprising SEQ ID NO: 214;
b) a VL1 comprising SEQ ID NO: 217 and a VH1 comprising SEQ ID NO: 218;
c) a VL1 comprising SEQ ID NO: 221 and a VH1 comprising SEQ ID NO: 222; and
d) a VL1 comprising SEQ ID NO: 225 and a VH1 comprising SEQ ID NO: 226;

and 2) the VL2 and VH2 are selected from the group consisting of:
a) a VL2 comprising SEQ ID NO: 5 and a VH2 comprising SEQ ID NO: 6;
b) a VL2 comprising SEQ ID NO: 9 and a VH2 comprising SEQ ID NO: 10;
c) a VL2 comprising SEQ ID NO: 13 and a VH2 comprising SEQ ID NO: 14;
d) a VL2 comprising SEQ ID NO: 17 and a VH2 comprising SEQ ID NO: 18;
e) a VL2 comprising SEQ ID NO: 21 and a VH2 comprising SEQ ID NO: 22;
f) a VL2 comprising SEQ ID NO: 25 and a VH2 comprising SEQ ID NO: 26;

g) a VL2 comprising SEQ ID NO: 29 and a VH2 comprising SEQ ID NO: 30;
h) a VL2 comprising SEQ ID NO: 33 and a VH2 comprising SEQ ID NO: 34;
i) a VL2 comprising SEQ ID NO: 37 and a VH2 comprising SEQ ID NO: 38;
j) a VL2 comprising SEQ ID NO: 41 and a VH2 comprising SEQ ID NO: 42;
k) a VL2 comprising SEQ ID NO: 45 and a VH2 comprising SEQ ID NO: 46;
l) a VL2 comprising SEQ ID NO: 49 and a VH2 comprising SEQ ID NO: 50; and
m) a VL2 comprising SEQ ID NO: 53 and a VH2 comprising SEQ ID NO: 54.

In one embodiment, the CL of the light chain is selected from the group consisting of SEQ ID NO: 883 and SEQ ID NO: 884.

In one embodiment, the CH1-hinge-CH2-CH3 of the heavy chain is selected from the group consisting of SEQ ID NO: 885 and SEQ ID NO: 886.

In one embodiment, the first peptide linker is selected from the group consisting of SEQ ID NOs: 888-893.

In one embodiment, the second peptide linker is selected from the group consisting of SEQ ID NOs: 887-893.

In one embodiment, the first peptide linker comprises SEQ ID NO: 889 and the second peptide linker comprises SEQ ID NO: 887.

In one embodiment,
the light chain comprises a sequence selected from the group consisting of SEQ ID NOs: 382, 386, 390, 394, 398, 402, 406, 410, 414, 418, 422, 426, 430, 434, 438, 442, 446, and 450; and
the heavy chain fusion protein comprises a sequence selected from the group consisting of SEQ ID NOs: 381, 385, 389, 393, 397, 401, 405, 409, 413, 417, 421, 425, 429, 433, 437, 441, 445, and 449.

In one embodiment, the light chain and the heavy chain fusion protein comprise polypeptides comprising amino acid sequences selected from the group consisting of:
SEQ ID NO: 382 and SEQ ID NO: 381, respectively;
SEQ ID NO: 386 and SEQ ID NO: 385, respectively;
SEQ ID NO: 390 and SEQ ID NO: 389, respectively;
SEQ ID NO: 394 and SEQ ID NO: 393, respectively;
SEQ ID NO: 398 and SEQ ID NO: 397, respectively;
SEQ ID NO: 402 and SEQ ID NO: 401, respectively;
SEQ ID NO: 406 and SEQ ID NO: 405, respectively;
SEQ ID NO: 410 and SEQ ID NO: 409, respectively;
SEQ ID NO: 414 and SEQ ID NO: 413, respectively;
SEQ ID NO: 418 and SEQ ID NO: 417, respectively;
SEQ ID NO: 422 and SEQ ID NO: 421, respectively;
SEQ ID NO: 426 and SEQ ID NO: 425, respectively;
SEQ ID NO: 430 and SEQ ID NO: 429, respectively;
SEQ ID NO: 434 and SEQ ID NO: 433, respectively;
SEQ ID NO: 438 and SEQ ID NO: 437, respectively;
SEQ ID NO: 442 and SEQ ID NO: 441, respectively;
SEQ ID NO: 446 and SEQ ID NO: 445, respectively; and
SEQ ID NO: 450 and SEQ ID NO: 449, respectively.

In one aspect, the present invention is directed to a multispecific antibody construct comprising:
a) two identical heavy chain fusion proteins each comprising a first heavy chain variable region (VH1) and a first CH1 domain, wherein the first CH1 domain is linked to a hinge-CH2-CH3 polypeptide, and wherein the hinge-CH2-CH3 polypeptide is linked to a second heavy chain variable region (VH2), wherein the VH2 is linked to a second CH1 domain; wherein
i) the VH1 or first CH1 domain comprises at least one amino acid substitution to introduce a positively charged amino acid at a residue selected from the group consisting of positions 39, 44, and 183 using EU numbering; and
ii) the VH2 or second CH1 domain comprises at least one amino acid substitution to introduce a negatively charged amino acid at a residue selected from the group consisting of a residue that corresponds to positions 39, 44, and 183 using EU numbering; and
b) a second polypeptide comprising a first light chain, wherein the first light chain comprises a first light chain variable region (VL1) and a first CL region; and wherein the VL1 or first CL domain comprises at least one amino acid substitution to introduce a negatively charged amino acid at a residue selected from the group consisting of positions 38, 100, and 176 using EU numbering; and
c) a third polypeptide comprising a second light chain, wherein the second light chain comprises a second light chain variable region (VL2) and a second CL region; and wherein the VL2 or second CL domain comprises at least one amino acid substitution to introduce a positively charged amino acid at a residue selected from the group consisting of positions 38, 100, and 176 using EU numbering;
wherein the VH1 and VL1 interact to bind a first antigen and wherein the VH2 and VL2 interact to bind a second antigen;
wherein:
the first antigen is human CD40 (SEQ ID NO: 1) and the second antigen is human mesothelin ("MSLN"; SEQ ID NO: 2); or
the first antigen is human MSLN (SEQ ID NO: 2) and the second antigen is human CD40 (SEQ ID NO: 1).

In one aspect, the present invention is directed to a multispecific antibody construct comprising:
a) two identical heavy chain fusion proteins each comprising a first heavy chain variable region (VH1) and a first CH1 domain, wherein the first CH1 domain is linked to a hinge-CH2-CH3 polypeptide, and wherein the hinge-CH2-CH3 polypeptide is linked to a second heavy chain variable region (VH2), wherein the VH2 is linked to a second CH1 domain; wherein
i) the VH1 or first CH1 domain comprises at least one amino acid substitution to introduce a negatively charged amino acid at a residue selected from the group consisting of positions 39, 44, and 183 using EU numbering; and
ii) the VH2 or second CH1 domain comprises at least one amino acid substitution to introduce a positively charged amino acid at a residue selected from the group consisting of a residue that corresponds to positions 39, 44, and 183 using EU numbering; and
b) a second polypeptide comprising a first light chain, wherein the first light chain comprises a first light chain variable region (VL1) and a first CL region; and wherein the VL1 or first CL domain comprises at least one amino acid substitution to introduce a positively charged amino acid at a residue selected from the group consisting of positions 38, 100, and 176 using EU numbering; and
c) a third polypeptide comprising a second light chain, wherein the second light chain comprises a second light chain variable region (VL2) and a second CL region; and wherein the VL2 or second CL domain comprises at least one amino acid substitution to introduce a negatively charged amino acid at a residue selected from the group consisting of positions 38, 100, and 176 using EU numbering;
wherein the VH1 and VL1 interact to bind a first antigen and wherein the VH2 and VL2 interact to bind a second antigen;

wherein:

the first antigen is human CD40 (SEQ ID NO: 1) and the second antigen is human mesothelin ("MSLN"; SEQ ID NO: 2); or the first antigen is human MSLN (SEQ ID NO: 2) and the second antigen is human CD40 (SEQ ID NO: 1).

In one embodiment, the hinge-CH2-CH3 polypeptide is linked to the VH2 via a peptide linker.

In one embodiment, the peptide linker comprises a sequence selected from the group consisting of (Gly$_3$Ser)$_2$ (SEQ ID NO: 916), (Gly$_4$Ser)$_2$ (SEQ ID NO: 888), (Gly$_3$Ser)$_3$ (SEQ ID NO: 917), (Gly$_4$Ser)$_3$ (SEQ ID NO: 889), (Gly$_3$Ser)$_4$ (SEQ ID NO: 918), (Gly$_4$Ser)$_4$ (SEQ ID NO: 890), (Gly$_3$Ser)$_5$ (SEQ ID NO: 919), (Gly$_4$Ser)$_5$ (SEQ ID NO: 920), (Gly$_3$Ser)$_6$ (SEQ ID NO: 921), and (Gly$_4$Ser)$_6$ (SEQ ID NO: 922).

In one embodiment,
a) the VH1 or first CH1 domain comprises a mutation selected from the group consisting of Q39K, G44K, and S183K using EU numbering;
b) the VH2 or second CH1 domain comprises a mutation selected from the group consisting of Q39E, G44E, and S183E using EU numbering;
c) the VL1 or first CL domain comprises a mutation selected from the group consisting of Q38E, G100E, and S176E using EU numbering; and
d) the VL2 or second CL domain comprises a mutation selected from the group consisting of Q38K, G100K, and S176K using EU numbering.

In one embodiment,
a) the first CH1 domain comprises a S183K mutation using EU numbering;
b) the second CH1 domain comprises a S183E mutation using EU numbering;
c) the first CL domain comprises a S176E mutation using EU numbering; and
d) the second CL domain comprises a S176K mutation using EU numbering.

In one embodiment,
a) the VH1 comprises a Q39K mutation and the first CH1 domain comprises a S183K mutation using EU numbering;
b) the VH2 comprises a Q39E mutation and the second CH1 domain comprises a S183E mutation using EU numbering;
c) the VL1 comprises a Q38E mutation and the first CL domain comprises a S176E mutation using EU numbering; and
d) the VL2 comprises a Q38K mutation and the second CL domain comprises a S176K mutation using EU numbering.

In one embodiment,
a) the first CH1 domain comprises G44K and S183K mutations using EU numbering;
b) the second CH1 domain comprises G44E and S183E mutations using EU numbering;
c) the first CL domain comprises G100E and S176E mutations using EU numbering; and
d) the second CL domain comprises G100K and S176K mutations using EU numbering.

In one embodiment,
a) the VH1 or first CH1 domain comprises a mutation selected from the group consisting of Q39E, G44E, and S183E using EU numbering;
b) the VH2 or second CH1 domain comprises a mutation selected from the group consisting of Q39K, G44K, and S183K using EU numbering;
c) the VL1 or first CL domain comprises a mutation selected from the group consisting of Q38K, G100K, and S176K using EU numbering; and
d) the VL2 or second CL domain comprises a mutation selected from the group consisting of Q38E, G100E, and S176E using EU numbering.

In one embodiment,
a) the first CH1 domain comprises a S183E mutation using EU numbering;
b) the second CH1 domain comprises a S183K mutation using EU numbering;
c) the first CL domain comprises a S176K mutation using EU numbering; and
d) the second CL domain comprises a S176E mutation using EU numbering.

In one embodiment,
a) the VH1 comprises a Q39E mutation and the first CH1 domain comprises a S183E mutation using EU numbering;
b) the VH2 comprises a Q39K mutation and the second CH1 domain comprises a S183K mutation using EU numbering;
c) the VL1 comprises a Q38K mutation and the first CL domain comprises a S176K mutation using EU numbering; and
d) the VL2 comprises a Q38E mutation and the second CL domain comprises a S176E mutation using EU numbering.

In one embodiment,
a) the first CH1 domain comprises G44E and S183E mutations using EU numbering;
b) the second CH1 domain comprises G44K and S183K mutations using EU numbering;
c) the first CL domain comprises G100K and S176K mutations using EU numbering; and
d) the second CL domain comprises G100E and S176E mutations using EU numbering.

In one embodiment, the hinge-CH2-CH3 polypeptide comprises an amino acid substitution selected from the group consisting of:
(i) N297G or N297A;
(ii) L234A and L235A; and
(iii) R292C and V302C;
wherein the amino acid numbering is EU numbering according to Kabat.

In one embodiment, the hinge-CH2-CH3 polypeptide comprises N297G, R292C, and V302C mutations, wherein the amino acid numbering is EU numbering according to Kabat.

In one embodiment, the first antigen is human CD40 (SEQ ID NO: 1) and the second antigen is human MSLN (SEQ ID NO: 2); and the VL1 comprises a CDRL1, a CDRL2, and a CDRL3 selected from the group consisting of:
SEQ ID NOs: 58, 59, and 60, respectively;
SEQ ID NOs: 64, 65, and 66, respectively;
SEQ ID NOs: 70, 71, and 72, respectively;
SEQ ID NOs: 76, 77, and 78, respectively;
SEQ ID NOs: 82, 83, and 84, respectively;
SEQ ID NOs: 88, 89, and 90, respectively;
SEQ ID NOs: 94, 95, and 96, respectively;

SEQ ID NOs: 100, 101, and 102, respectively;
SEQ ID NOs: 106, 107, and 108, respectively;
SEQ ID NOs: 112, 113, and 114, respectively;
SEQ ID NOs: 118, 119, and 120, respectively;
SEQ ID NOs: 124, 125, and 126, respectively; and
SEQ ID NOs: 130, 131, and 132, respectively;
the VH1 comprises a CDRH1, a CDRH2, and a CDRH3 selected from the group consisting of:
SEQ ID NOs: 136, 137, and 138, respectively;
SEQ ID NOs: 142, 143, and 144, respectively;
SEQ ID NOs: 148, 149, and 150, respectively;
SEQ ID NOs: 154, 155, and 156, respectively;
SEQ ID NOs: 160, 161, and 162, respectively;
SEQ ID NOs: 166, 167, and 168, respectively;
SEQ ID NOs: 172, 173, and 174, respectively;
SEQ ID NOs: 178, 179, and 180, respectively;
SEQ ID NOs: 184, 185, and 186, respectively;
SEQ ID NOs: 190, 191, and 192, respectively;
SEQ ID NOs: 196, 197, and 198, respectively;
SEQ ID NOs: 202, 203, and 204, respectively; and
SEQ ID NOs: 208, 209, and 210, respectively;
the VL2 comprises a CDRL1, a CDRL2, and a CDRL3 selected from the group consisting of:
SEQ ID NOs: 230, 231, and 232, respectively;
SEQ ID NOs: 236, 237, and 238, respectively;
SEQ ID NOs: 242, 243, and 244, respectively; and
SEQ ID NOs: 248, 249, and 250, respectively;
and the VH2 comprises a CDRH1, a CDRH2, and a CDRH3 selected from the group consisting of:
SEQ ID NOs: 254, 255, and 256, respectively;
SEQ ID NOs: 260, 261, and 262, respectively;
SEQ ID NOs: 266, 267, and 268, respectively; and
SEQ ID NOs: 272, 273, and 274, respectively.

64. The antibody construct of claim 63, wherein
1) the VL1 and VH1 are selected from the group consisting of:
   a) a VL1 comprising a CDRL1, a CDRL2, and a CDRL3 selected from the group consisting of SEQ ID NOs: 58, 59, and 60, respectively; and a VH1 comprising a CDRH1, a CDRH2, and a CDRH3 selected from the group consisting of SEQ ID NOs: 136, 137, and 138, respectively;
   b) a VL1 comprising a CDRL1, a CDRL2, and a CDRL3 selected from the group consisting of SEQ ID NOs: 64, 65, and 66, respectively; and a VH1 comprising a CDRH1, a CDRH2, and a CDRH3 selected from the group consisting of SEQ ID NOs: 142, 143, and 144, respectively;
   c) a VL1 comprising a CDRL1, a CDRL2, and a CDRL3 selected from the group consisting of SEQ ID NOs: 70, 71, and 72, respectively; and a VH1 comprising a CDRH1, a CDRH2, and a CDRH3 selected from the group consisting of SEQ ID NOs: 148, 149, and 150, respectively;
   d) a VL1 comprising a CDRL1, a CDRL2, and a CDRL3 selected from the group consisting of SEQ ID NOs: 76, 77, and 6780, respectively; and a VH1 comprising a CDRH1, a CDRH2, and a CDRH3 selected from the group consisting of SEQ ID NOs: 154, 155, and 156, respectively;
   e) a VL1 comprising a CDRL1, a CDRL2, and a CDRL3 selected from the group consisting of SEQ ID NOs: 82, 83, and 84, respectively; and a VH1 comprising a CDRH1, a CDRH2, and a CDRH3 selected from the group consisting of SEQ ID NOs: 160, 161, and 162, respectively;
   f) a VL1 comprising a CDRL1, a CDRL2, and a CDRL3 selected from the group consisting of SEQ ID NOs: 88, 89, and 90, respectively; and a VH1 comprising a CDRH1, a CDRH2, and a CDRH3 selected from the group consisting of SEQ ID NOs: 166, 167, and 168, respectively;
   g) a VL1 comprising a CDRL1, a CDRL2, and a CDRL3 selected from the group consisting of SEQ ID NOs: 94, 95, and 96, respectively; and a VH1 comprising a CDRH1, a CDRH2, and a CDRH3 selected from the group consisting of SEQ ID NOs: 172, 173, and 174, respectively;
   h) a VL1 comprising a CDRL1, a CDRL2, and a CDRL3 selected from the group consisting of SEQ ID NOs: 100, 101, and 102, respectively; and a VH1 comprising a CDRH1, a CDRH2, and a CDRH3 selected from the group consisting of SEQ ID NOs: 178, 179, and 180, respectively;
   i) a VL1 comprising a CDRL1, a CDRL2, and a CDRL3 selected from the group consisting of SEQ ID NOs: 106, 107, and 108, respectively; and a VH1 comprising a CDRH1, a CDRH2, and a CDRH3 selected from the group consisting of SEQ ID NOs: 184, 185, and 186, respectively;
   j) a VL1 comprising a CDRL1, a CDRL2, and a CDRL3 selected from the group consisting of SEQ ID NOs: 112, 113, and 114, respectively; and a VH1 comprising a CDRH1, a CDRH2, and a CDRH3 selected from the group consisting of SEQ ID NOs: 190, 191, and 192, respectively;
   k) a VL1 comprising a CDRL1, a CDRL2, and a CDRL3 selected from the group consisting of SEQ ID NOs: 118, 119, and 120, respectively; and a VH1 comprising a CDRH1, a CDRH2, and a CDRH3 selected from the group consisting of SEQ ID NOs: 196, 197, and 198, respectively;
   l) a VL1 comprising a CDRL1, a CDRL2, and a CDRL3 selected from the group consisting of SEQ ID NOs: 124, 125, and 126, respectively; and a VH1 comprising a CDRH1, a CDRH2, and a CDRH3 selected from the group consisting of SEQ ID NOs: 202, 203, and 204, respectively; and
   m) a VL1 comprising a CDRL1, a CDRL2, and a CDRL3 selected from the group consisting of SEQ ID NOs: 130, 131, and 132, respectively; and a VH1 comprising a CDRH1, a CDRH2, and a CDRH3 selected from the group consisting of SEQ ID NOs: 208, 209, and 210, respectively;
   and
2) the VL2 and VH2 are selected from the group consisting of:
   a) a VL2 comprising a CDRL1, a CDRL2, and a CDRL3 selected from the group consisting of SEQ ID NOs: 230, 231, and 232, respectively; and a VH2 comprising a CDRH1, a CDRH2, and a CDRH3 selected from the group consisting of SEQ ID NOs: 254, 255, and 256, respectively;
   b) a VL2 comprising a CDRL1, a CDRL2, and a CDRL3 selected from the group consisting of SEQ ID NOs: 236, 237, and 238, respectively; and a VH2 comprising a CDRH1, a CDRH2, and a CDRH3 selected from the group consisting of SEQ ID NOs: 260, 261, and 262, respectively;
   c) a VL2 comprising a CDRL1, a CDRL2, and a CDRL3 selected from the group consisting of SEQ ID NOs: 242, 243, and 244, respectively; and a VH2 comprising a CDRH1, a CDRH2, and a CDRH3 selected from the group consisting of SEQ ID NOs: 266, 267, and 268, respectively; and d) a VL2 comprising a CDRL1, a CDRL2, and a CDRL3 selected from the group consisting of SEQ ID NOs: 248, 249, and 250, respectively; and a VH2 comprising a CDRH1, a CDRH2, and a CDRH3 selected from the group consisting of SEQ ID NOs: 272, 273, and 274, respectively.

In one embodiment:

the VL1 comprises an amino acid sequence selected from the group consisting of SEQ ID NOs: 5, 9, 13, 17, 21, 25, 29, 33, 37, 41, 45, 49, and 53;

the VH1 comprises an amino acid sequence selected from the group consisting of SEQ ID NO: 6, 10, 14, 18, 22, 26, 30, 34, 38, 42, 46, 50, and 54;

the VL2 comprises an amino acid sequence selected from the group consisting of SEQ ID NO: 213, 217, 221, and 225;

the VH2 comprises an amino acid sequence selected from the group consisting of SEQ ID NO: 214, 218, 222, and 226.

In one embodiment:

1) the VL1 and VH1 are selected from the group consisting of:
 a) a VL1 comprising SEQ ID NO: 5 and a VH1 comprising SEQ ID NO: 6;
 b) a VL1 comprising SEQ ID NO: 9 and a VH1 comprising SEQ ID NO: 10;
 c) a VL1 comprising SEQ ID NO: 13 and a VH1 comprising SEQ ID NO: 14;
 d) a VL1 comprising SEQ ID NO: 17 and a VH1 comprising SEQ ID NO: 18;
 e) a VL1 comprising SEQ ID NO: 21 and a VH1 comprising SEQ ID NO: 22;
 f) a VL1 comprising SEQ ID NO: 25 and a VH1 comprising SEQ ID NO: 26;
 g) a VL1 comprising SEQ ID NO: 29 and a VH1 comprising SEQ ID NO: 30;
 h) a VL1 comprising SEQ ID NO: 33 and a VH1 comprising SEQ ID NO: 34;
 i) a VL1 comprising SEQ ID NO: 37 and a VH1 comprising SEQ ID NO: 38;
 j) a VL1 comprising SEQ ID NO: 41 and a VH1 comprising SEQ ID NO: 42;
 k) a VL1 comprising SEQ ID NO: 45 and a VH1 comprising SEQ ID NO: 46;
 l) a VL1 comprising SEQ ID NO: 49 and a VH1 comprising SEQ ID NO: 50; and
 m) a VL1 comprising SEQ ID NO: 53 and a VH1 comprising SEQ ID NO: 54;
and 2) the VL2 and VH2 are selected from the group consisting of:
 a) a VL2 comprising SEQ ID NO: 213 and a VH2 comprising SEQ ID NO: 214;
 b) a VL2 comprising SEQ ID NO: 217 and a VH2 comprising SEQ ID NO: 218;
 c) a VL2 comprising SEQ ID NO: 221 and a VH2 comprising SEQ ID NO: 222; and
 d) a VL2 comprising SEQ ID NO: 225 and a VH2 comprising SEQ ID NO: 226.

In one aspect, the present invention is directed to a polynucleotide encoding the first light chain of the antibody construct.

In one aspect, the present invention is directed to a polynucleotide encoding the second light chain of the antibody construct.

In one aspect, the present invention is directed to a polynucleotide encoding the heavy chain fusion protein of the antibody construct.

In one aspect, the present invention is directed to a vector comprising:
 a) the polynucleotide encoding the first light chain of the antibody construct,
 b) the polynucleotide encoding the second light chain of the antibody construct,
 c) the polynucleotide encoding the heavy chain fusion protein of the antibody construct, or
 d) any combination of a), b), and c).

In one aspect, the present invention is directed to a host cell transformed or transfected with the vector or polynucleotide according to the present invention.

In one aspect, the present invention is directed to a process for producing the antibody construct according to the present invention, the process comprising culturing a host cell comprising a polynucleotide encoding the first light chain, a polynucleotide encoding the second light chain and a polynucleotide encoding the heavy chain fusion protein under conditions allowing the expression of the antibody construct, and recovering the produced antibody construct from the culture.

In one aspect, the present invention is directed to a pharmaceutical composition comprising the antibody construct according to the present invention and a carrier, stabilizer, excipient, diluent, solubilizer, surfactant, emulsifier, preservative or adjuvant.

In one aspect, the present invention is directed to a method for treating or ameliorating a solid tumor disease or a metastatic cancer disease, comprising the step of administering to a subject in need thereof an effective amount of the antibody construct according to the present invention.

In one embodiment, the solid tumor disease is selected from the group consisting of: ovarian cancer, pancreatic cancer, mesothelioma, lung cancer, gastric cancer and triple negative breast cancer disease or a metastatic cancer disease derived from any of the foregoing.

In one aspect, the present invention is directed to a kit comprising the antibody construct according to the present invention and, optionally, directions for use.

In one embodiment, the first antigen is human MSLN (SEQ ID NO: 2) and the second antigen is human CD40 (SEQ ID NO: 1); wherein:
 the VL1 comprises a CDRL1, a CDRL2, and a CDRL3 selected from the group consisting of:
  SEQ ID NOs: 230, 231, and 232, respectively;
  SEQ ID NOs: 236, 237, and 238, respectively;
  SEQ ID NOs: 242, 243, and 244, respectively; and
  SEQ ID NOs: 248, 249, and 250, respectively;
 the VH1 comprises a CDRH1, a CDRH2, and a CDRH3 selected from the group consisting of:
  SEQ ID NOs: 254, 255, and 256, respectively;
  SEQ ID NOs: 260, 261, and 262, respectively;
  SEQ ID NOs: 266, 267, and 268, respectively; and
  SEQ ID NOs: 272, 273, and 274, respectively;
 the VL2 comprises a CDRL1, a CDRL2, and a CDRL3 selected from the group consisting of:
  SEQ ID NOs: 58, 59, and 60, respectively;
  SEQ ID NOs: 64, 65, and 66, respectively;
  SEQ ID NOs: 70, 71, and 72, respectively;
  SEQ ID NOs: 76, 77, and 78, respectively;
  SEQ ID NOs: 82, 83, and 84, respectively;
  SEQ ID NOs: 88, 89, and 90, respectively;
  SEQ ID NOs: 94, 95, and 96, respectively;
  SEQ ID NOs: 100, 101, and 102, respectively;

SEQ ID NOs: 106, 107, and 108, respectively;
SEQ ID NOs: 112, 113, and 114, respectively;
SEQ ID NOs: 118, 119, and 120, respectively;
SEQ ID NOs: 124, 125, and 126, respectively; and
SEQ ID NOs: 130, 131, and 132, respectively;
and
the VH2 comprises a CDRH1, a CDRH2, and a CDRH3 selected from the group consisting of:
SEQ ID NOs: 136, 137, and 138, respectively;
SEQ ID NOs: 142, 143, and 144, respectively;
SEQ ID NOs: 148, 149, and 150, respectively;
SEQ ID NOs: 154, 155, and 156, respectively;
SEQ ID NOs: 160, 161, and 162, respectively;
SEQ ID NOs: 166, 167, and 168, respectively;
SEQ ID NOs: 172, 173, and 174, respectively;
SEQ ID NOs: 178, 179, and 180, respectively;
SEQ ID NOs: 184, 185, and 186, respectively;
SEQ ID NOs: 190, 191, and 192, respectively;
SEQ ID NOs: 196, 197, and 198, respectively;
SEQ ID NOs: 202, 203, and 204, respectively; and
SEQ ID NOs: 208, 209, and 210, respectively.

In one embodiment,
1) the VL1 and VH1 are selected from the group consisting of:
  a) a VL1 comprising a CDRL1, a CDRL2, and a CDRL3 selected from the group consisting of SEQ ID NOs: 230, 231, and 232, respectively; and a VH1 comprising a CDRH1, a CDRH2, and a CDRH3 selected from the group consisting of SEQ ID NOs: 254, 255, and 256, respectively;
  b) a VL1 comprising a CDRL1, a CDRL2, and a CDRL3 selected from the group consisting of SEQ ID NOs: 236, 237, and 238, respectively; and a VH1 comprising a CDRH1, a CDRH2, and a CDRH3 selected from the group consisting of SEQ ID NOs: 260, 261, and 262, respectively;
  c) a VL1 comprising a CDRL1, a CDRL2, and a CDRL3 selected from the group consisting of SEQ ID NOs: 242, 243, and 244, respectively; and a VH1 comprising a CDRH1, a CDRH2, and a CDRH3 selected from the group consisting of SEQ ID NOs: 266, 267, and 268, respectively; and
  d) a VL1 comprising a CDRL1, a CDRL2, and a CDRL3 selected from the group consisting of SEQ ID NOs: 248, 249, and 250, respectively; and a VH1 comprising a CDRH1, a CDRH2, and a CDRH3 selected from the group consisting of SEQ ID NOs: 272, 273, and 274, respectively;
and
2) the VL2 and VH2 are selected from the group consisting of:
  a) a VL2 comprising a CDRL1, a CDRL2, and a CDRL3 selected from the group consisting of SEQ ID NOs: 58, 59, and 60, respectively; and a VH2 comprising a CDRH1, a CDRH2, and a CDRH3 selected from the group consisting of SEQ ID NOs: 136, 137, and 138, respectively;
  b) a VL2 comprising a CDRL1, a CDRL2, and a CDRL3 selected from the group consisting of SEQ ID NOs: 64, 65, and 66, respectively; and a VH2 comprising a CDRH1, a CDRH2, and a CDRH3 selected from the group consisting of SEQ ID NOs: 142, 143, and 144, respectively;
  c) a VL2 comprising a CDRL1, a CDRL2, and a CDRL3 selected from the group consisting of SEQ ID NOs: 70, 71, and 72, respectively; and a VH2 comprising a CDRH1, a CDRH2, and a CDRH3 selected from the group consisting of SEQ ID NOs: 148, 149, and 150, respectively;
  d) a VL2 comprising a CDRL1, a CDRL2, and a CDRL3 selected from the group consisting of SEQ ID NOs: 76, 77, and 6780, respectively; and a VH2 comprising a CDRH1, a CDRH2, and a CDRH3 selected from the group consisting of SEQ ID NOs: 154, 155, and 156, respectively;
  e) a VL2 comprising a CDRL1, a CDRL2, and a CDRL3 selected from the group consisting of SEQ ID NOs: 82, 83, and 84, respectively; and a VH2 comprising a CDRH1, a CDRH2, and a CDRH3 selected from the group consisting of SEQ ID NOs: 160, 161, and 162, respectively;
  f) a VL2 comprising a CDRL1, a CDRL2, and a CDRL3 selected from the group consisting of SEQ ID NOs: 88, 89, and 90, respectively; and a VH2 comprising a CDRH1, a CDRH2, and a CDRH3 selected from the group consisting of SEQ ID NOs: 166, 167, and 168, respectively;
  g) a VL2 comprising a CDRL1, a CDRL2, and a CDRL3 selected from the group consisting of SEQ ID NOs: 94, 95, and 96, respectively; and a VH2 comprising a CDRH1, a CDRH2, and a CDRH3 selected from the group consisting of SEQ ID NOs: 172, 173, and 174, respectively;
  h) a VL2 comprising a CDRL1, a CDRL2, and a CDRL3 selected from the group consisting of SEQ ID NOs: 100, 101, and 102, respectively; and a VH2 comprising a CDRH1, a CDRH2, and a CDRH3 selected from the group consisting of SEQ ID NOs: 178, 179, and 180, respectively;
  i) a VL2 comprising a CDRL1, a CDRL2, and a CDRL3 selected from the group consisting of SEQ ID NOs: 106, 107, and 108, respectively; and a VH2 comprising a CDRH1, a CDRH2, and a CDRH3 selected from the group consisting of SEQ ID NOs: 184, 185, and 186, respectively;
  j) a VL2 comprising a CDRL1, a CDRL2, and a CDRL3 selected from the group consisting of SEQ ID NOs: 112, 113, and 114, respectively; and a VH2 comprising a CDRH1, a CDRH2, and a CDRH3 selected from the group consisting of SEQ ID NOs: 190, 191, and 192, respectively;
  k) a VL2 comprising a CDRL1, a CDRL2, and a CDRL3 selected from the group consisting of SEQ ID NOs: 118, 119, and 120, respectively; and a VH2 comprising a CDRH1, a CDRH2, and a CDRH3 selected from the group consisting of SEQ ID NOs: 196, 197, and 198, respectively;
  l) a VL2 comprising a CDRL1, a CDRL2, and a CDRL3 selected from the group consisting of SEQ ID NOs: 124, 125, and 126, respectively; and a VH2 comprising a CDRH1, a CDRH2, and a CDRH3 selected from the group consisting of SEQ ID NOs: 202, 203, and 204, respectively; and
  m) a VL2 comprising a CDRL1, a CDRL2, and a CDRL3 selected from the group consisting of SEQ ID NOs: 130, 131, and 132, respectively; and a VH2 comprising a CDRH1, a CDRH2, and a CDRH3 selected from the group consisting of SEQ ID NOs: 208, 209, and 210, respectively.

In one embodiment,
the VL1 comprises an amino acid sequence selected from the group consisting of SEQ ID NO: 213, 217, 221, and 225;

the VH1 comprises an amino acid sequence selected from the group consisting of SEQ ID NO: 214, 218, 222, and 226;

the VL2 comprises an amino acid sequence selected from the group consisting of SEQ ID NOs: 5, 9, 13, 17, 21, 25, 29, 33, 37, 41, 45, 49, and 53; and the VH2 comprises an amino acid sequence selected from the group consisting of SEQ ID NO: 6, 10, 14, 18, 22, 26, 30, 34, 38, 42, 46, 50, and 54.

In one embodiment, 1) the VL1 and VH1 are selected from the group consisting of:
 a) a VL1 comprising SEQ ID NO: 213 and a VH1 comprising SEQ ID NO: 214;
 b) a VL1 comprising SEQ ID NO: 217 and a VH1 comprising SEQ ID NO: 218;
 c) a VL1 comprising SEQ ID NO: 221 and a VH1 comprising SEQ ID NO: 222; and
 d) a VL1 comprising SEQ ID NO: 225 and a VH1 comprising SEQ ID NO: 226;
and 2) the VL2 and VH2 are selected from the group consisting of:
 a) a VL2 comprising SEQ ID NO: 5 and a VH2 comprising SEQ ID NO: 6;
 b) a VL2 comprising SEQ ID NO: 9 and a VH2 comprising SEQ ID NO: 10;
 c) a VL2 comprising SEQ ID NO: 13 and a VH2 comprising SEQ ID NO: 14;
 d) a VL2 comprising SEQ ID NO: 17 and a VH2 comprising SEQ ID NO: 18;
 e) a VL2 comprising SEQ ID NO: 21 and a VH2 comprising SEQ ID NO: 22;
 f) a VL2 comprising SEQ ID NO: 25 and a VH2 comprising SEQ ID NO: 26;
 g) a VL2 comprising SEQ ID NO: 29 and a VH2 comprising SEQ ID NO: 30;
 h) a VL2 comprising SEQ ID NO: 33 and a VH2 comprising SEQ ID NO: 34;
 i) a VL2 comprising SEQ ID NO: 37 and a VH2 comprising SEQ ID NO: 38;
 j) a VL2 comprising SEQ ID NO: 41 and a VH2 comprising SEQ ID NO: 42;
 k) a VL2 comprising SEQ ID NO: 45 and a VH2 comprising SEQ ID NO: 46;
 l) a VL2 comprising SEQ ID NO: 49 and a VH2 comprising SEQ ID NO: 50; and
 m) a VL2 comprising SEQ ID NO: 53 and a VH2 comprising SEQ ID NO: 54.

In one aspect, the present invention is directed to an antigen binding protein that specifically binds and agonizes human CD40 (SEQ ID NO: 1), the antigen binding protein comprising a light chain variable region (VL) and a heavy chain variable region (VH), wherein:

the VL comprises a CDRL1, a CDRL2, and a CDRL3 selected from the group consisting of:
 SEQ ID NOs: 58, 59, and 60, respectively;
 SEQ ID NOs: 64, 65, and 66, respectively;
 SEQ ID NOs: 70, 71, and 72, respectively;
 SEQ ID NOs: 76, 77, and 78, respectively;
 SEQ ID NOs: 82, 83, and 84, respectively;
 SEQ ID NOs: 88, 89, and 90, respectively;
 SEQ ID NOs: 94, 95, and 96, respectively;
 SEQ ID NOs: 100, 101, and 102, respectively;
 SEQ ID NOs: 106, 107, and 108, respectively;
 SEQ ID NOs: 112, 113, and 114, respectively;
 SEQ ID NOs: 118, 119, and 120, respectively;
 SEQ ID NOs: 124, 125, and 126, respectively; and
 SEQ ID NOs: 130, 131, and 132, respectively;
and the VH comprises a CDRH1, a CDRH2, and a CDRH3 selected from the group consisting of:
 SEQ ID NOs: 136, 137, and 138, respectively;
 SEQ ID NOs: 142, 143, and 144, respectively;
 SEQ ID NOs: 148, 149, and 150, respectively;
 SEQ ID NOs: 154, 155, and 156, respectively;
 SEQ ID NOs: 160, 161, and 162, respectively;
 SEQ ID NOs: 166, 167, and 168, respectively;
 SEQ ID NOs: 172, 173, and 174, respectively;
 SEQ ID NOs: 178, 179, and 180, respectively;
 SEQ ID NOs: 184, 185, and 186, respectively;
 SEQ ID NOs: 190, 191, and 192, respectively;
 SEQ ID NOs: 196, 197, and 198, respectively;
 SEQ ID NOs: 202, 203, and 204, respectively; and
 SEQ ID NOs: 208, 209, and 210, respectively.

In one embodiment, the multispecific antibody construct comprises mutations limiting Fc receptor binding and thus decreases Fc receptor-dependent CD40 agonism.

In one embodiment, the VL and VH are selected from the group consisting of:
 a) a VL comprising a CDRL1, a CDRL2, and a CDRL3 selected from the group consisting of SEQ ID NOs: 58, 59, and 60, respectively; and a VH comprising a CDRH1, a CDRH2, and a CDRH3 selected from the group consisting of SEQ ID NOs: 136, 137, and 138, respectively;
 b) a VL comprising a CDRL1, a CDRL2, and a CDRL3 selected from the group consisting of SEQ ID NOs: 64, 65, and 66, respectively; and a VH comprising a CDRH1, a CDRH2, and a CDRH3 selected from the group consisting of SEQ ID NOs: 142, 143, and 144, respectively;
 c) a VL comprising a CDRL1, a CDRL2, and a CDRL3 selected from the group consisting of SEQ ID NOs: 70, 71, and 72, respectively; and a VH comprising a CDRH1, a CDRH2, and a CDRH3 selected from the group consisting of SEQ ID NOs: 148, 149, and 150, respectively;
 d) a VL comprising a CDRL1, a CDRL2, and a CDRL3 selected from the group consisting of SEQ ID NOs: 76, 77, and 6780, respectively; and a VH comprising a CDRH1, a CDRH2, and a CDRH3 selected from the group consisting of SEQ ID NOs: 154, 155, and 156, respectively;
 e) a VL comprising a CDRL1, a CDRL2, and a CDRL3 selected from the group consisting of SEQ ID NOs: 82, 83, and 84, respectively; and a VH comprising a CDRH1, a CDRH2, and a CDRH3 selected from the group consisting of SEQ ID NOs: 160, 161, and 162, respectively;
 f) a VL comprising a CDRL1, a CDRL2, and a CDRL3 selected from the group consisting of SEQ ID NOs: 88, 89, and 90, respectively; and a VH comprising a CDRH1, a CDRH2, and a CDRH3 selected from the group consisting of SEQ ID NOs: 166, 167, and 168, respectively;
 g) a VL comprising a CDRL1, a CDRL2, and a CDRL3 selected from the group consisting of SEQ ID NOs: 94, 95, and 96, respectively; and a VH comprising a CDRH1, a CDRH2, and a CDRH3 selected from the group consisting of SEQ ID NOs: 172, 173, and 174, respectively;

h) a VL comprising a CDRL1, a CDRL2, and a CDRL3 selected from the group consisting of SEQ ID NOs: 100, 101, and 102, respectively; and a VH comprising a CDRH1, a CDRH2, and a CDRH3 selected from the group consisting of SEQ ID NOs: 178, 179, and 180, respectively;

i) a VL comprising a CDRL1, a CDRL2, and a CDRL3 selected from the group consisting of SEQ ID NOs: 106, 107, and 108, respectively; and a VH comprising a CDRH1, a CDRH2, and a CDRH3 selected from the group consisting of SEQ ID NOs: 184, 185, and 186, respectively;

j) a VL comprising a CDRL1, a CDRL2, and a CDRL3 selected from the group consisting of SEQ ID NOs: 112, 113, and 114, respectively; and a VH comprising a CDRH1, a CDRH2, and a CDRH3 selected from the group consisting of SEQ ID NOs: 190, 191, and 192, respectively;

k) a VL comprising a CDRL1, a CDRL2, and a CDRL3 selected from the group consisting of SEQ ID NOs: 118, 119, and 120, respectively; and a VH comprising a CDRH1, a CDRH2, and a CDRH3 selected from the group consisting of SEQ ID NOs: 196, 197, and 198, respectively;

l) a VL comprising a CDRL1, a CDRL2, and a CDRL3 selected from the group consisting of SEQ ID NOs: 124, 125, and 126, respectively; and a VH comprising a CDRH1, a CDRH2, and a CDRH3 selected from the group consisting of SEQ ID NOs: 202, 203, and 204, respectively; and m) a VL comprising a CDRL1, a CDRL2, and a CDRL3 selected from the group consisting of SEQ ID NOs: 130, 131, and 132, respectively; and a VH comprising a CDRH1, a CDRH2, and a CDRH3 selected from the group consisting of SEQ ID NOs: 208, 209, and 210, respectively.

In one embodiment,
the VL comprises an amino acid sequence selected from the group consisting of SEQ ID NOs: 5, 9, 13, 17, 21, 25, 29, 33, 37, 41, 45, 49, and 53; and
the VH comprises an amino acid sequence selected from the group consisting of SEQ ID NO: 6, 10, 14, 18, 22, 26, 30, 34, 38, 42, 46, 50, and 54.

In one embodiment,
the VL and VH are selected from the group consisting of:
a) a VL comprising SEQ ID NO: 5 and a VH comprising SEQ ID NO: 6;
b) a VL comprising SEQ ID NO: 9 and a VH comprising SEQ ID NO: 10;
c) a VL comprising SEQ ID NO: 13 and a VH comprising SEQ ID NO: 14;
d) a VL comprising SEQ ID NO: 17 and a VH comprising SEQ ID NO: 18;
e) a VL comprising SEQ ID NO: 21 and a VH comprising SEQ ID NO: 22;
f) a VL comprising SEQ ID NO: 25 and a VH comprising SEQ ID NO: 26;
g) a VL comprising SEQ ID NO: 29 and a VH comprising SEQ ID NO: 30;
h) a VL comprising SEQ ID NO: 33 and a VH comprising SEQ ID NO: 34;
i) a VL comprising SEQ ID NO: 37 and a VH comprising SEQ ID NO: 38;
j) a VL comprising SEQ ID NO: 41 and a VH comprising SEQ ID NO: 42;
k) a VL comprising SEQ ID NO: 45 and a VH comprising SEQ ID NO: 46;
l) a VL comprising SEQ ID NO: 49 and a VH comprising SEQ ID NO: 50; and
m) a VL comprising SEQ ID NO: 53 and a VH comprising SEQ ID NO: 54.

In one embodiment, the heavy chain comprises an amino acid substitution selected from the group consisting of:
(i) N297G or N297A;
(ii) L234A and L235A; and
(iii) R292C and V302C;
wherein the amino acid numbering is EU numbering according to Kabat.

In one embodiment, the heavy chain comprises N297G, R292C, and V302C mutations, wherein the amino acid numbering is EU numbering according to Kabat.

In one embodiment, the antigen binding protein further comprises a light chain CL polypeptide linked to the VL, wherein the CL polypeptide is selected from the group consisting of SEQ ID NO: 883 and SEQ ID NO: 884.

In one embodiment, the antigen binding protein further comprises a heavy chain CH1-hinge-CH2-CH3 polypeptide wherein the CH1-hinge-CH2-CH3 polypeptide is selected from the group consisting of SEQ ID NO: 885 and SEQ ID NO: 886.

In one embodiment, the antigen binding protein further comprises a second antigen binding portion that specifically binds a second antigen.

In one embodiment, the second antigen is a tumor associated antigen (TAA).

BRIEF DESCRIPTION OF THE DRAWINGS

FIGS. 6A-6D depict Generation of MC38-human EPCAM and B16F10-human EPCAM expressing cell line.

FIGS. 8A-8B depict Mouse surrogate anti-CD40×human EPCAM bispecific molecule has tumor-localized, TAA-mediated X-linking-dependent activity in vivo.

DETAILED DESCRIPTION

Figure 1A:
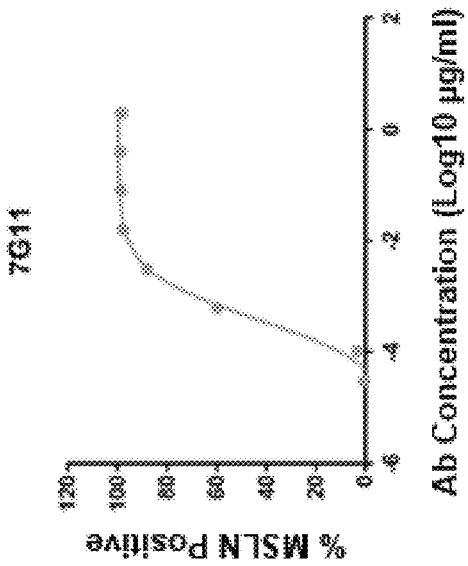
FIGS. 1A-1D depict on cell binding of anti-MSLN antibodies to CHO cells expressing human MSLN.
Figure 1B:
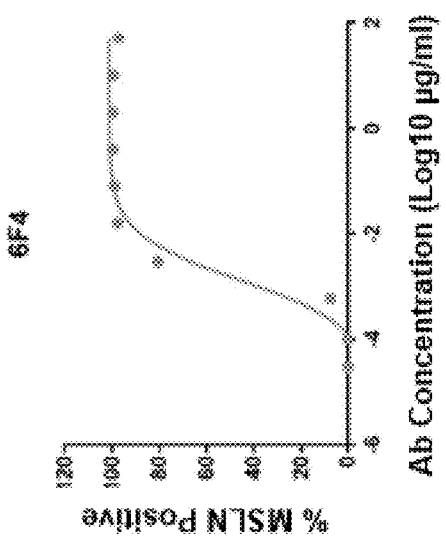
Figure 1C:
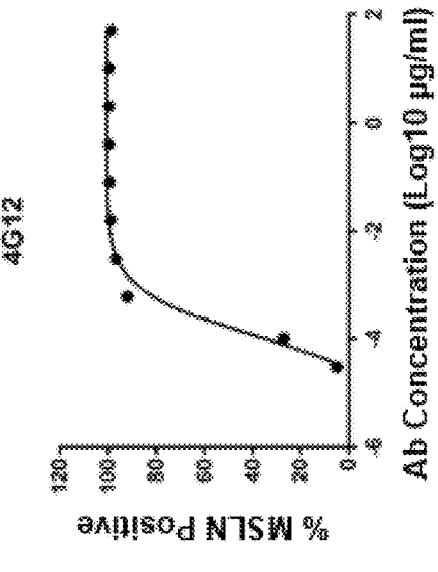
Figure 1D:
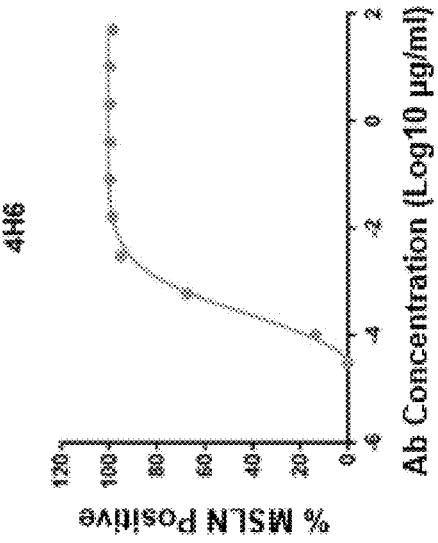

Unless otherwise indicated, the term "at least" preceding a series of elements is to be understood to refer to every element in the series. Those skilled in the art will recognize, or be able to ascertain using no more than routine experimentation, many equivalents to the specific embodiments of the invention described herein. Such equivalents are intended to be encompassed by the present invention.

The term "and/or" wherever used herein includes the meaning of "and", "or" and "all or any other combination of the elements connected by said term".

The term "about" or "approximately" as used herein means within ±20%, preferably within ±15%, more preferably within ±10%, and most preferably within ±5% of a given value or range.

Throughout this specification and the claims which follow, unless the context requires otherwise, the word "comprise", and variations such as "comprises" and "comprising", will be understood to imply the inclusion of a stated integer or step or group of integers or steps but not the exclusion of any other integer or step or group of integer or step. When used herein the term "comprising" can be substituted with the term "containing" or "including" or sometimes when used herein with the term "having".

When used herein "consisting of" excludes any element, step, or ingredient not specified in the claim element. When used herein, "consisting essentially of" does not exclude materials or steps that do not materially affect the basic and novel characteristics of the claim.

In each instance herein any of the terms "comprising", "consisting essentially of" and "consisting of" may be replaced with either of the other two terms.

As used herein, the term "antigen binding protein" refers to a protein that specifically binds to one or more target antigens. An antigen binding protein can include an antibody and functional fragments thereof. A "functional antibody fragment" is a portion of an antibody that lacks at least some of the amino acids present in a full-length heavy chain and/or light chain, but which is still capable of specifically binding to an antigen. A functional antibody fragment includes, but is not limited to, a Fab fragment, a Fab' fragment, a F(ab')2 fragment, a Fv fragment, a Fd fragment, and a complementarity determining region (CDR) fragment, and can be derived from any mammalian source, such as human, mouse, rat, rabbit, or camelid. Functional antibody fragments may compete for binding of a target antigen with an intact antibody and the fragments may be produced by the modification of intact antibodies (e.g. enzymatic or chemical cleavage) or synthesized de novo using recombinant DNA technologies or peptide synthesis.

The term "antibody construct" refers to a molecule in which the structure and/or function is/are based on the structure and/or function of an antibody, e.g., of a full-length or whole immunoglobulin molecule. An antibody construct is hence capable of binding to its specific target or antigen. Furthermore, an antibody construct according to the invention comprises the minimum structural requirements of an antibody which allow for the target binding. This minimum requirement may e.g. be defined by the presence of at least the three light chain CDRs (i.e. CDR1, CDR2 and CDR3 of the VL region) and/or the three heavy chain CDRs (i.e. CDR1, CDR2 and CDR3 of the VH region), preferably of all six CDRs. The antibodies on which the constructs according to the invention are based include for example monoclonal, recombinant, chimeric, deimmunized, humanized and human antibodies.

In certain embodiments, the antigen binding proteins of the invention comprise antibodies. As used herein, the term "antibody" refers to a tetrameric immunoglobulin protein comprising two light chain polypeptides (about 25 kDa each) and two heavy chain polypeptides (about 50-70 kDa each). The term "light chain" or "immunoglobulin light chain" refers to a polypeptide comprising, from amino terminus to carboxyl terminus, a single immunoglobulin light chain variable region (VL) and a single immunoglobulin light chain constant domain (CL). The immunoglobulin light chain constant domain (CL) can be kappa (κ) or lambda (λ). The term "heavy chain" or "immunoglobulin heavy chain" refers to a polypeptide comprising, from amino terminus to carboxyl terminus, a single immunoglobulin heavy chain variable region (VH), an immunoglobulin heavy chain constant domain 1 (CH1), an immunoglobulin hinge region, an immunoglobulin heavy chain constant domain 2 (CH2), an immunoglobulin heavy chain constant domain 3 (CH3), and optionally an immunoglobulin heavy chain constant domain 4 (CH4). Heavy chains are classified as mu (μ), delta (Δ), gamma (γ), alpha (a), and epsilon (E), and define the antibody's isotype as IgM, IgD, IgG, IgA, and IgE, respectively. The IgG-class and IgA-class antibodies are further divided into subclasses, namely, IgG1, IgG2, IgG3, and IgG4, and IgA1 and IgA2, respectively. The heavy chains in IgG, IgA, and IgD antibodies have three domains (CH1, CH2, and CH3), whereas the heavy chains in IgM and IgE antibodies have four domains (CH1, CH2, CH3, and CH4). The immunoglobulin heavy chain constant domains can be from any immunoglobulin isotype, including subtypes. The antibody chains are linked together via inter-polypeptide disulfide bonds between the CL domain and the CH1 domain (i e between the light and heavy chain) and between the hinge regions of the antibody heavy chains.

In a human antibody, CH1 means a region having the amino acid sequence at positions 118 to 215 of the EU index. A highly flexible amino acid region called a "hinge region" exists between CH1 and CH2. CH2 represents a region having the amino acid sequence at positions 231 to 340 of the EU index, and CH3 represents a region having the amino acid sequence at positions 341 to 446 of the EU index.

"CL" represents a constant region of a light chain. In the case of a κ chain of a human antibody, CL represents a region having the amino acid sequence at positions 108 to 214 of the EU index. In a λ chain, CL represents a region having the amino acid sequence at positions 108 to 215.

Both the EU index as in Kabat et al., Sequences of Proteins of Immunological Interest, 5th Ed. Public Health Service, National Institutes of Health, Bethesda, MD (1991) and AHo numbering schemes (Honegger A. and Plückthun A. *J Mol Biol.* 2001 Jun. 8; 309(3):657-70) can be used in the present invention. Amino acid positions and complementarity determining regions (CDRs) and framework regions (FR) of a given antibody may be identified using either system. For example, EU heavy chain positions of 39, 44, 183, 356, 357, 360, 370, 392, 399, and 409 are equivalent to AHo heavy chain positions 46, 51, 230, 484, 485, 491, 501, 528, 535, and 551, respectively.

In one aspect, the present invention is directed to an antigen binding protein that specifically binds and agonizes human CD40 (SEQ ID NO: 1), the antigen binding protein comprising a light chain variable region (VL) and a heavy chain variable region (VH), wherein:

the VL comprises a CDRL1, a CDRL2, and a CDRL3 selected from the group consisting of:
  SEQ ID NOs: 58, 59, and 60, respectively;
  SEQ ID NOs: 64, 65, and 66, respectively;
  SEQ ID NOs: 70, 71, and 72, respectively;
  SEQ ID NOs: 76, 77, and 78, respectively;
  SEQ ID NOs: 82, 83, and 84, respectively;
  SEQ ID NOs: 88, 89, and 90, respectively;

SEQ ID NOs: 94, 95, and 96, respectively;
SEQ ID NOs: 100, 101, and 102, respectively;
SEQ ID NOs: 106, 107, and 108, respectively;
SEQ ID NOs: 112, 113, and 114, respectively;
SEQ ID NOs: 118, 119, and 120, respectively;
SEQ ID NOs: 124, 125, and 126, respectively; and
SEQ ID NOs: 130, 131, and 132, respectively;
and
the VH comprises a CDRH1, a CDRH2, and a CDRH3 selected from the group consisting of:
SEQ ID NOs: 136, 137, and 138, respectively;
SEQ ID NOs: 142, 143, and 144, respectively;
SEQ ID NOs: 148, 149, and 150, respectively;
SEQ ID NOs: 154, 155, and 156, respectively;
SEQ ID NOs: 160, 161, and 162, respectively;
SEQ ID NOs: 166, 167, and 168, respectively;
SEQ ID NOs: 172, 173, and 174, respectively;
SEQ ID NOs: 178, 179, and 180, respectively;
SEQ ID NOs: 184, 185, and 186, respectively;
SEQ ID NOs: 190, 191, and 192, respectively;
SEQ ID NOs: 196, 197, and 198, respectively;
SEQ ID NOs: 202, 203, and 204, respectively; and
SEQ ID NOs: 208, 209, and 210, respectively.
In one embodiment,
the VL and VH are selected from the group consisting of:
a) a VL comprising a CDRL1, a CDRL2, and a CDRL3 selected from the group consisting of SEQ ID NOs: 58, 59, and 60, respectively; and a VH comprising a CDRH1, a CDRH2, and a CDRH3 selected from the group consisting of SEQ ID NOs: 136, 137, and 138, respectively;
b) a VL comprising a CDRL1, a CDRL2, and a CDRL3 selected from the group consisting of SEQ ID NOs: 64, 65, and 66, respectively; and a VH comprising a CDRH1, a CDRH2, and a CDRH3 selected from the group consisting of SEQ ID NOs: 142, 143, and 144, respectively;
c) a VL comprising a CDRL1, a CDRL2, and a CDRL3 selected from the group consisting of SEQ ID NOs: 70, 71, and 72, respectively; and a VH comprising a CDRH1, a CDRH2, and a CDRH3 selected from the group consisting of SEQ ID NOs: 148, 149, and 150, respectively;
d) a VL comprising a CDRL1, a CDRL2, and a CDRL3 selected from the group consisting of SEQ ID NOs: 76, 77, and 6780, respectively; and a VH comprising a CDRH1, a CDRH2, and a CDRH3 selected from the group consisting of SEQ ID NOs: 154, 155, and 156, respectively;
e) a VL comprising a CDRL1, a CDRL2, and a CDRL3 selected from the group consisting of SEQ ID NOs: 82, 83, and 84, respectively; and a VH comprising a CDRH1, a CDRH2, and a CDRH3 selected from the group consisting of SEQ ID NOs: 160, 161, and 162, respectively;
f) a VL comprising a CDRL1, a CDRL2, and a CDRL3 selected from the group consisting of SEQ ID NOs: 88, 89, and 90, respectively; and a VH comprising a CDRH1, a CDRH2, and a CDRH3 selected from the group consisting of SEQ ID NOs: 166, 167, and 168, respectively;
g) a VL comprising a CDRL1, a CDRL2, and a CDRL3 selected from the group consisting of SEQ ID NOs: 94, 95, and 96, respectively; and a VH comprising a CDRH1, a CDRH2, and a CDRH3 selected from the group consisting of SEQ ID NOs: 172, 173, and 174, respectively;
h) a VL comprising a CDRL1, a CDRL2, and a CDRL3 selected from the group consisting of SEQ ID NOs: 100, 101, and 102, respectively; and a VH comprising a CDRH1, a CDRH2, and a CDRH3 selected from the group consisting of SEQ ID NOs: 178, 179, and 180, respectively;
i) a VL comprising a CDRL1, a CDRL2, and a CDRL3 selected from the group consisting of SEQ ID NOs: 106, 107, and 108, respectively; and a VH comprising a CDRH1, a CDRH2, and a CDRH3 selected from the group consisting of SEQ ID NOs: 184, 185, and 186, respectively;
j) a VL comprising a CDRL1, a CDRL2, and a CDRL3 selected from the group consisting of SEQ ID NOs: 112, 113, and 114, respectively; and a VH comprising a CDRH1, a CDRH2, and a CDRH3 selected from the group consisting of SEQ ID NOs: 190, 191, and 192, respectively;
k) a VL comprising a CDRL1, a CDRL2, and a CDRL3 selected from the group consisting of SEQ ID NOs: 118, 119, and 120, respectively; and a VH comprising a CDRH1, a CDRH2, and a CDRH3 selected from the group consisting of SEQ ID NOs: 196, 197, and 198, respectively;
l) a VL comprising a CDRL1, a CDRL2, and a CDRL3 selected from the group consisting of SEQ ID NOs: 124, 125, and 126, respectively; and a VH comprising a CDRH1, a CDRH2, and a CDRH3 selected from the group consisting of SEQ ID NOs: 202, 203, and 204, respectively; and
m) a VL comprising a CDRL1, a CDRL2, and a CDRL3 selected from the group consisting of SEQ ID NOs: 130, 131, and 132, respectively; and a VH comprising a CDRH1, a CDRH2, and a CDRH3 selected from the group consisting of SEQ ID NOs: 208, 209, and 210, respectively.
In one embodiment,
the VL comprises an amino acid sequence selected from the group consisting of SEQ ID NOs: 5, 9, 13, 17, 21, 25, 29, 33, 37, 41, 45, 49, and 53; and
the VH comprises an amino acid sequence selected from the group consisting of SEQ ID NO: 6, 10, 14, 18, 22, 26, 30, 34, 38, 42, 46, 50, and 54.
In one embodiment,
the VL and VH are selected from the group consisting of:
a) a VL comprising SEQ ID NO: 5 and a VH comprising SEQ ID NO: 6;
b) a VL comprising SEQ ID NO: 9 and a VH comprising SEQ ID NO: 10;
c) a VL comprising SEQ ID NO: 13 and a VH comprising SEQ ID NO: 14;
d) a VL comprising SEQ ID NO: 17 and a VH comprising SEQ ID NO: 18;
e) a VL comprising SEQ ID NO: 21 and a VH comprising SEQ ID NO: 22;
f) a VL comprising SEQ ID NO: 25 and a VH comprising SEQ ID NO: 26;
g) a VL comprising SEQ ID NO: 29 and a VH comprising SEQ ID NO: 30;
h) a VL comprising SEQ ID NO: 33 and a VH comprising SEQ ID NO: 34;
i) a VL comprising SEQ ID NO: 37 and a VH comprising SEQ ID NO: 38;
j) a VL comprising SEQ ID NO: 41 and a VH comprising SEQ ID NO: 42;
k) a VL comprising SEQ ID NO: 45 and a VH comprising SEQ ID NO: 46;

l) a VL comprising SEQ ID NO: 49 and a VH comprising SEQ ID NO: 50; and m) a VL comprising SEQ ID NO: 53 and a VH comprising SEQ ID NO: 54.

In one embodiment, the antigen binding protein further comprises a second antigen binding portion that specifically binds a second antigen.

In one embodiment, the second antigen is a tumor associated antigen (TAA).

"Antibody constructs" according to the invention are fragments of full-length antibodies, such as VH, VHH, VL, (s)dAb, Fv, Fd, Fab, Fab', F(ab')2 or "r IgG" ("half antibody"). Antibody constructs according to the invention may also be modified fragments of antibodies, also called antibody variants, such as scFv, di-scFv or bi(s)-scFv, scFv-Fc, scFv-zipper, scFab, Fab2, Fab3, diabodies, single chain diabodies, tandem diabodies (Tandab's), tandem di-scFv, tandem tri-scFv, "minibodies" exemplified by a structure which is as follows: (VH-VL-CH3)2, (scFv-CH3)2, ((scFv)2-CH3+CH3), ((scFv)2-CH3) or (scFv-CH3-scFv)2, multibodies such as triabodies or tetrabodies, and single domain antibodies such as nanobodies or single variable domain antibodies comprising merely one variable domain, which might be VHH, VH or VL, that specifically bind an antigen or epitope independently of other V regions or domains. Also, included within the definition of "antibody construct" are multispecific molecules that incorporate multiple types of antibodies and antibody constructs, for example, IgG-scFv which comprises a scFv linked to an IgG or an IgG-Fab, which comprises a Fab fragment linked to an IgG. In one embodiment, a scFv linked to an immunoglobulin heavy chain is called "a heavy chain fusion protein". In another embodiment, a VH-CH1 polypeptide linked to an immunoglobulin heavy chain is called "a heavy chain fusion protein".

A "binding domain", or "antigen binding domain", may typically comprise an antibody light chain variable region (VL) and an antibody heavy chain variable region (VH); however, it does not have to comprise both. Fd fragments, for example, have two VH regions and often retain some antigen-binding function of the intact antigen-binding domain. Additional examples for the format of antibody fragments, antibody variants or binding domains include (1) a Fab fragment, a monovalent fragment having the VL, VH, CL and CH1 domains; (2) a F(ab')2 fragment, a bivalent fragment having two Fab fragments linked by a disulfide bridge at the hinge region; (3) an Fd fragment having the two VH and CH1 domains; (4) an Fv fragment having the VL and VH domains of a single arm of an antibody, (5) a dAb fragment (Ward et al., (1989) Nature 341:544-546), which has a VH domain; (6) an isolated complementarity determining region (CDR), and (7) a single chain Fv (scFv), the latter being preferred (for example, derived from an scFV-library). Examples for embodiments of antibody constructs according to the invention are e.g. described in WO 00/006605, WO 2005/040220, WO 2008/1 19567, WO 2010/037838, WO 2013/026837, WO 2013/026833, US 2014/0308285, US 2014/0302037, WO 2014/144722, WO 2014/151910, and WO 2015/048272.

Furthermore, the definition of the term "antibody construct" includes monovalent, bivalent and polyvalent/multivalent constructs and, thus, monospecific constructs, specifically binding to only one antigenic structure, as well as bispecific and multispecific constructs, which specifically bind more than one antigenic structure, e.g. two, three or more, through distinct binding domains. Moreover, the definition of the term "antibody construct" includes molecules consisting of only one polypeptide chain as well as molecules consisting of more than one polypeptide chain, which chains can be either identical (homodimers, homotrimers or homo oligomers) or different (heterodimer, heterotrimer or heterooligomer). Examples for the above identified antibodies and variants or derivatives thereof are described inter alia in Harlow and Lane, Antibodies a laboratory manual, CSHL Press (1988) and Using Antibodies: a laboratory manual, CSHL Press (1999), Kontermann and Dubel, Antibody Engineering, Springer, 2nd ed. 2010 and Little, Recombinant Antibodies for Immunotherapy, Cambridge University Press 2009.

The antibody constructs of the present invention are preferably "in vitro generated antibody constructs". This term refers to an antibody construct according to the above definition where all or part of the variable region (e.g., at least one CDR) is generated in a non-immune cell selection, e.g., an in vitro phage display, protein chip or any other method in which candidate sequences can be tested for their ability to bind to an antigen. This term thus preferably excludes sequences generated solely by genomic rearrangement in an immune cell in an animal A "recombinant antibody" is an antibody made through the use of recombinant DNA technology or genetic engineering.

In one aspect, the present invention is directed to a multispecific antibody construct comprising:

(i) a first antibody comprising two light chains and two heavy chains, wherein the light chains comprise a first variable region (VL1) and a light chain constant region (CL);

the heavy chains comprise a first heavy variable region (VH1) and CH1, hinge, CH2, and CH3 regions;

the heavy chains comprise at least one amino acid substitution that results in a reduced binding affinity of the heavy chain for human Fc gamma RI receptor as compared with an unsubstituted heavy chain; and (ii) a scFv comprising a second light chain variable region (VL2) and a second heavy chain variable region (VH2) of a second antibody, wherein the VL2 and the VH2 are connected via a first peptide linker, wherein the scFv is fused at its amino terminus to the carboxyl terminus of each of the heavy chains through a second peptide linker such that a heavy chain fusion protein is formed; and wherein the first antibody specifically binds to and agonizes human CD40 (SEQ ID NO: 1) and the scFv specifically binds to human mesothelin (MSLN) (SEQ ID NO: 2).

In one embodiment, the multispecific antibody construct specifically agonizes CD40 in a MSLN-dependent fashion.

In one embodiment, the multispecific antibody construct comprises mutations limiting Fc receptor binding and thus decreases Fc receptor-dependent CD40 agonism.

In one embodiment, the two light chains are identical and the two heavy chain fusion proteins are identical.

In one embodiment, the VL1 comprises a CDRL1, a CDRL2, and a CDRL3 selected from the group consisting of:

SEQ ID NOs: 58, 59, and 60, respectively;
SEQ ID NOs: 64, 65, and 66, respectively;
SEQ ID NOs: 70, 71, and 72, respectively;
SEQ ID NOs: 76, 77, and 78, respectively;
SEQ ID NOs: 82, 83, and 84, respectively;
SEQ ID NOs: 88, 89, and 90, respectively;
SEQ ID NOs: 94, 95, and 96, respectively;
SEQ ID NOs: 100, 101, and 102, respectively;
SEQ ID NOs: 106, 107, and 108, respectively;
SEQ ID NOs: 112, 113, and 114, respectively;

SEQ ID NOs: 118, 119, and 120, respectively;
SEQ ID NOs: 124, 125, and 126, respectively; and
SEQ ID NOs: 130, 131, and 132, respectively;
the VH1 comprises a CDRH1, a CDRH2, and a CDRH3 selected from the group consisting of:
SEQ ID NOs: 136, 137, and 138, respectively;
SEQ ID NOs: 142, 143, and 144, respectively;
SEQ ID NOs: 148, 149, and 150, respectively;
SEQ ID NOs: 154, 155, and 156, respectively;
SEQ ID NOs: 160, 161, and 162, respectively;
SEQ ID NOs: 166, 167, and 168, respectively;
SEQ ID NOs: 172, 173, and 174, respectively;
SEQ ID NOs: 178, 179, and 180, respectively;
SEQ ID NOs: 184, 185, and 186, respectively;
SEQ ID NOs: 190, 191, and 192, respectively;
SEQ ID NOs: 196, 197, and 198, respectively;
SEQ ID NOs: 202, 203, and 204, respectively; and
SEQ ID NOs: 208, 209, and 210, respectively;
the VL2 comprises a CDRL1, a CDRL2, and a CDRL3 selected from the group consisting of:
SEQ ID NOs: 230, 231, and 232, respectively;
SEQ ID NOs: 236, 237, and 238, respectively;
SEQ ID NOs: 242, 243, and 244, respectively; and
SEQ ID NOs: 248, 249, and 250, respectively;
and the VH2 comprises a CDRH1, a CDRH2, and a CDRH3 selected from the group consisting of:
SEQ ID NOs: 254, 255, and 256, respectively;
SEQ ID NOs: 260, 261, and 262, respectively;
SEQ ID NOs: 266, 267, and 268, respectively; and
SEQ ID NOs: 272, 273, and 274, respectively.

In one embodiment, 1) the VL1 and VH1 are selected from the group consisting of:
  a) a VL1 comprising a CDRL1, a CDRL2, and a CDRL3 selected from the group consisting of SEQ ID NOs: 58, 59, and 60, respectively; and a VH1 comprising a CDRH1, a CDRH2, and a CDRH3 selected from the group consisting of SEQ ID NOs: 136, 137, and 138, respectively;
  b) a VL1 comprising a CDRL1, a CDRL2, and a CDRL3 selected from the group consisting of SEQ ID NOs: 64, 65, and 66, respectively; and a VH1 comprising a CDRH1, a CDRH2, and a CDRH3 selected from the group consisting of SEQ ID NOs: 142, 143, and 144, respectively;
  c) a VL1 comprising a CDRL1, a CDRL2, and a CDRL3 selected from the group consisting of SEQ ID NOs: 70, 71, and 72, respectively; and a VH1 comprising a CDRH1, a CDRH2, and a CDRH3 selected from the group consisting of SEQ ID NOs: 148, 149, and 150, respectively;
  d) a VL1 comprising a CDRL1, a CDRL2, and a CDRL3 selected from the group consisting of SEQ ID NOs: 76, 77, and 6780, respectively; and a VH1 comprising a CDRH1, a CDRH2, and a CDRH3 selected from the group consisting of SEQ ID NOs: 154, 155, and 156, respectively;
  e) a VL1 comprising a CDRL1, a CDRL2, and a CDRL3 selected from the group consisting of SEQ ID NOs: 82, 83, and 84, respectively; and a VH1 comprising a CDRH1, a CDRH2, and a CDRH3 selected from the group consisting of SEQ ID NOs: 160, 161, and 162, respectively;
  f) a VL1 comprising a CDRL1, a CDRL2, and a CDRL3 selected from the group consisting of SEQ ID NOs: 88, 89, and 90, respectively; and a VH1 comprising a CDRH1, a CDRH2, and a CDRH3 selected from the group consisting of SEQ ID NOs: 166, 167, and 168, respectively;
  g) a VL1 comprising a CDRL1, a CDRL2, and a CDRL3 selected from the group consisting of SEQ ID NOs: 94, 95, and 96, respectively; and a VH1 comprising a CDRH1, a CDRH2, and a CDRH3 selected from the group consisting of SEQ ID NOs: 172, 173, and 174, respectively;
  h) a VL1 comprising a CDRL1, a CDRL2, and a CDRL3 selected from the group consisting of SEQ ID NOs: 100, 101, and 102, respectively; and a VH1 comprising a CDRH1, a CDRH2, and a CDRH3 selected from the group consisting of SEQ ID NOs: 178, 179, and 180, respectively;
  i) a VL1 comprising a CDRL1, a CDRL2, and a CDRL3 selected from the group consisting of SEQ ID NOs: 106, 107, and 108, respectively; and a VH1 comprising a CDRH1, a CDRH2, and a CDRH3 selected from the group consisting of SEQ ID NOs: 184, 185, and 186, respectively;
  j) a VL1 comprising a CDRL1, a CDRL2, and a CDRL3 selected from the group consisting of SEQ ID NOs: 112, 113, and 114, respectively; and a VH1 comprising a CDRH1, a CDRH2, and a CDRH3 selected from the group consisting of SEQ ID NOs: 190, 191, and 192, respectively;
  k) a VL1 comprising a CDRL1, a CDRL2, and a CDRL3 selected from the group consisting of SEQ ID NOs: 118, 119, and 120, respectively; and a VH1 comprising a CDRH1, a CDRH2, and a CDRH3 selected from the group consisting of SEQ ID NOs: 196, 197, and 198, respectively;
  l) a VL1 comprising a CDRL1, a CDRL2, and a CDRL3 selected from the group consisting of SEQ ID NOs: 124, 125, and 126, respectively; and a VH1 comprising a CDRH1, a CDRH2, and a CDRH3 selected from the group consisting of SEQ ID NOs: 202, 203, and 204, respectively; and
  m) a VL1 comprising a CDRL1, a CDRL2, and a CDRL3 selected from the group consisting of SEQ ID NOs: 130, 131, and 132, respectively; and a VH1 comprising a CDRH1, a CDRH2, and a CDRH3 selected from the group consisting of SEQ ID NOs: 208, 209, and 210, respectively;
and
2) the VL2 and VH2 are selected from the group consisting of:
  a) a VL2 comprising a CDRL1, a CDRL2, and a CDRL3 selected from the group consisting of SEQ ID NOs: 230, 231, and 232, respectively; and a VH2 comprising a CDRH1, a CDRH2, and a CDRH3 selected from the group consisting of SEQ ID NOs: 254, 255, and 256, respectively;
  b) a VL2 comprising a CDRL1, a CDRL2, and a CDRL3 selected from the group consisting of SEQ ID NOs: 236, 237, and 238, respectively; and a VH2 comprising a CDRH1, a CDRH2, and a CDRH3 selected from the group consisting of SEQ ID NOs: 260, 261, and 262, respectively;
  c) a VL2 comprising a CDRL1, a CDRL2, and a CDRL3 selected from the group consisting of SEQ ID NOs: 242, 243, and 244, respectively; and a VH2 comprising a CDRH1, a CDRH2, and a CDRH3 selected from the group consisting of SEQ ID NOs: 266, 267, and 268, respectively; and d) a VL2 comprising a CDRL1, a CDRL2, and a CDRL3 selected from the group consisting of SEQ ID NOs: 248, 249, and 250, respectively; and a VH2 comprising a CDRH1, a CDRH2, and a CDRH3 selected from the group consisting of SEQ ID NOs: 272, 273, and 274, respectively.

In one embodiment, the VL1 comprises an amino acid sequence selected from the group consisting of SEQ ID NOs: 5, 9, 13, 17, 21, 25, 29, 33, 37, 41, 45, 49, and 53;

the VH1 comprises an amino acid sequence selected from the group consisting of SEQ ID NO: 6, 10, 14, 18, 22, 26, 30, 34, 38, 42, 46, 50, and 54;

the VL2 comprises an amino acid sequence selected from the group consisting of SEQ ID NO: 213, 217, 221, and 225;

the VH2 comprises an amino acid sequence selected from the group consisting of SEQ ID NO: 214, 218, 222, and 226.

In one embodiment, 1) the VL1 and VH1 are selected from the group consisting of:
   a) a VL1 comprising SEQ ID NO: 5 and a VH1 comprising SEQ ID NO: 6;
   b) a VL1 comprising SEQ ID NO: 9 and a VH1 comprising SEQ ID NO: 10;
   c) a VL1 comprising SEQ ID NO: 13 and a VH1 comprising SEQ ID NO: 14;
   d) a VL1 comprising SEQ ID NO: 17 and a VH1 comprising SEQ ID NO: 18;
   e) a VL1 comprising SEQ ID NO: 21 and a VH1 comprising SEQ ID NO: 22;
   f) a VL1 comprising SEQ ID NO: 25 and a VH1 comprising SEQ ID NO: 26;
   g) a VL1 comprising SEQ ID NO: 29 and a VH1 comprising SEQ ID NO: 30;
   h) a VL1 comprising SEQ ID NO: 33 and a VH1 comprising SEQ ID NO: 34;
   i) a VL1 comprising SEQ ID NO: 37 and a VH1 comprising SEQ ID NO: 38;
   j) a VL1 comprising SEQ ID NO: 41 and a VH1 comprising SEQ ID NO: 42;
   k) a VL1 comprising SEQ ID NO: 45 and a VH1 comprising SEQ ID NO: 46;
   l) a VL1 comprising SEQ ID NO: 49 and a VH1 comprising SEQ ID NO: 50; and
   m) a VL1 comprising SEQ ID NO: 53 and a VH1 comprising SEQ ID NO: 54;
and 2) the VL2 and VH2 are selected from the group consisting of:
   a) a VL2 comprising SEQ ID NO: 213 and a VH2 comprising SEQ ID NO: 214;
   b) a VL2 comprising SEQ ID NO: 217 and a VH2 comprising SEQ ID NO: 218;
   c) a VL2 comprising SEQ ID NO: 221 and a VH2 comprising SEQ ID NO: 222; and
   d) a VL2 comprising SEQ ID NO: 225 and a VH2 comprising SEQ ID NO: 226.

In one embodiment, the light chain comprises a sequence selected from the group consisting of SEQ ID NOs: 286, 290, 294, 298, 302, 306, 310, 314, 318, 322, 326, 330, 336, 342, 346, 350, 354, 358, 362, 366, 370, 374, and 378; and the heavy chain fusion protein comprises a sequence selected from the group consisting of SEQ ID Nos: 285, 289, 293, 297, 301, 305, 309, 313, 317, 321, 325, 329, 333, 337, 341, 345, 349, 353, 357, 361, 365, 369, 373, and 377.

In one embodiment, the light chain and the heavy chain fusion protein comprise polypeptides comprising amino acid sequences selected from the group consisting of:
SEQ ID NO: 286 and SEQ ID NO: 285, respectively;
SEQ ID NO: 290 and SEQ ID NO: 289, respectively;
SEQ ID NO: 294 and SEQ ID NO: 293, respectively;
SEQ ID NO: 298 and SEQ ID NO: 297, respectively;
SEQ ID NO: 302 and SEQ ID NO: 301, respectively;
SEQ ID NO: 306 and SEQ ID NO: 305, respectively;
SEQ ID NO: 310 and SEQ ID NO: 309, respectively;
SEQ ID NO: 314 and SEQ ID NO: 313, respectively;
SEQ ID NO: 318 and SEQ ID NO: 317, respectively;
SEQ ID NO: 322 and SEQ ID NO: 321, respectively;
SEQ ID NO: 326 and SEQ ID NO: 325, respectively;
SEQ ID NO: 330 and SEQ ID NO: 329, respectively;
SEQ ID NO: 334 and SEQ ID NO: 333, respectively;
SEQ ID NO: 338 and SEQ ID NO: 337, respectively;
SEQ ID NO: 342 and SEQ ID NO: 341, respectively;
SEQ ID NO: 346 and SEQ ID NO: 345, respectively;
SEQ ID NO: 350 and SEQ ID NO: 349, respectively;
SEQ ID NO: 354 and SEQ ID NO: 353, respectively;
SEQ ID NO: 358 and SEQ ID NO: 357, respectively;
SEQ ID NO: 362 and SEQ ID NO: 361, respectively;
SEQ ID NO: 366 and SEQ ID NO: 365, respectively;
SEQ ID NO: 370 and SEQ ID NO: 369, respectively;
SEQ ID NO: 374 and SEQ ID NO: 373, respectively; and
SEQ ID NO: 378 and SEQ ID NO: 377, respectively.

In another aspect, the present invention is directed to a multispecific antibody construct comprising:

(i) a first antibody comprising two light chains and two heavy chains, wherein the light chains comprise a first variable region (VL1) and a light chain constant region (CL);

the heavy chains comprise a first heavy variable region (VH1) and CH1, hinge, CH2, and CH3 regions;

the heavy chains comprise at least one amino acid substitution that results in a reduced binding affinity of the heavy chain for human Fc gamma RI receptor as compared with an unsubstituted heavy chain; and (ii) a scFv comprising a second light chain variable region (VL2) and a second heavy chain variable region (VH2) of a second antibody, wherein the VL2 and the VH2 are connected via a first peptide linker, wherein the scFv is fused at its amino terminus to the carboxyl terminus of each of the heavy chains through a second peptide linker such that a heavy chain fusion protein is formed; and wherein the first antibody specifically binds to human mesothelin (MSLN) (SEQ ID NO: 2) and the scFv specifically binds to and agonizes human CD40 (SEQ ID NO: 1).

In one embodiment, the multispecific antibody construct specifically agonizes CD40 in a MSLN-dependent fashion.

In one embodiment, the multispecific antibody construct comprises mutations limiting Fc receptor binding and thus decreases Fc receptor-dependent CD40 agonism.

In one embodiment, the two light chains are identical and the two heavy chain fusion proteins are identical.

In one embodiment:

the VL1 comprises a CDRL1, a CDRL2, and a CDRL3 selected from the group consisting of:
SEQ ID NOs: 230, 231, and 232, respectively;
SEQ ID NOs: 236, 237, and 238, respectively;
SEQ ID NOs: 242, 243, and 244, respectively; and
SEQ ID NOs: 248, 249, and 250, respectively;

the VH1 comprises a CDRH1, a CDRH2, and a CDRH3 selected from the group consisting of:
    SEQ ID NOs: 254, 255, and 256, respectively;
    SEQ ID NOs: 260, 261, and 262, respectively;
    SEQ ID NOs: 266, 267, and 268, respectively; and
    SEQ ID NOs: 272, 273, and 274, respectively;
the VL2 comprises a CDRL1, a CDRL2, and a CDRL3 selected from the group consisting of:
    SEQ ID NOs: 58, 59, and 60, respectively;
    SEQ ID NOs: 64, 65, and 66, respectively;
    SEQ ID NOs: 70, 71, and 72, respectively;
    SEQ ID NOs: 76, 77, and 78, respectively;
    SEQ ID NOs: 82, 83, and 84, respectively;
    SEQ ID NOs: 88, 89, and 90, respectively;
    SEQ ID NOs: 94, 95, and 96, respectively;
    SEQ ID NOs: 100, 101, and 102, respectively;
    SEQ ID NOs: 106, 107, and 108, respectively;
    SEQ ID NOs: 112, 113, and 114, respectively;
    SEQ ID NOs: 118, 119, and 120, respectively;
    SEQ ID NOs: 124, 125, and 126, respectively; and
    SEQ ID NOs: 130, 131, and 132, respectively;
and
the VH2 comprises a CDRH1, a CDRH2, and a CDRH3 selected from the group consisting of:
    SEQ ID NOs: 136, 137, and 138, respectively;
    SEQ ID NOs: 142, 143, and 144, respectively;
    SEQ ID NOs: 148, 149, and 150, respectively;
    SEQ ID NOs: 154, 155, and 156, respectively;
    SEQ ID NOs: 160, 161, and 162, respectively;
    SEQ ID NOs: 166, 167, and 168, respectively;
    SEQ ID NOs: 172, 173, and 174, respectively;
    SEQ ID NOs: 178, 179, and 180, respectively;
    SEQ ID NOs: 184, 185, and 186, respectively;
    SEQ ID NOs: 190, 191, and 192, respectively;
    SEQ ID NOs: 196, 197, and 198, respectively;
    SEQ ID NOs: 202, 203, and 204, respectively; and
    SEQ ID NOs: 208, 209, and 210, respectively.

In one embodiment,
1) the VL1 and VH1 are selected from the group consisting of:
    a) a VL1 comprising a CDRL1, a CDRL2, and a CDRL3 selected from the group consisting of SEQ ID NOs: 230, 231, and 232, respectively; and a VH1 comprising a CDRH1, a CDRH2, and a CDRH3 selected from the group consisting of SEQ ID NOs: 254, 255, and 256, respectively;
    b) a VL1 comprising a CDRL1, a CDRL2, and a CDRL3 selected from the group consisting of SEQ ID NOs: 236, 237, and 238, respectively; and a VH1 comprising a CDRH1, a CDRH2, and a CDRH3 selected from the group consisting of SEQ ID NOs: 260, 261, and 262, respectively;
    c) a VL1 comprising a CDRL1, a CDRL2, and a CDRL3 selected from the group consisting of SEQ ID NOs: 242, 243, and 244, respectively; and a VH1 comprising a CDRH1, a CDRH2, and a CDRH3 selected from the group consisting of SEQ ID NOs: 266, 267, and 268, respectively; and
    d) a VL1 comprising a CDRL1, a CDRL2, and a CDRL3 selected from the group consisting of SEQ ID NOs: 248, 249, and 250, respectively; and a VH1 comprising a CDRH1, a CDRH2, and a CDRH3 selected from the group consisting of SEQ ID NOs: 272, 273, and 274, respectively;
and
2) the VL2 and VH2 are selected from the group consisting of:
    a) a VL2 comprising a CDRL1, a CDRL2, and a CDRL3 selected from the group consisting of SEQ ID NOs: 58, 59, and 60, respectively; and a VH2 comprising a CDRH1, a CDRH2, and a CDRH3 selected from the group consisting of SEQ ID NOs: 136, 137, and 138, respectively;
    b) a VL2 comprising a CDRL1, a CDRL2, and a CDRL3 selected from the group consisting of SEQ ID NOs: 64, 65, and 66, respectively; and a VH2 comprising a CDRH1, a CDRH2, and a CDRH3 selected from the group consisting of SEQ ID NOs: 142, 143, and 144, respectively;
    c) a VL2 comprising a CDRL1, a CDRL2, and a CDRL3 selected from the group consisting of SEQ ID NOs: 70, 71, and 72, respectively; and a VH2 comprising a CDRH1, a CDRH2, and a CDRH3 selected from the group consisting of SEQ ID NOs: 148, 149, and 150, respectively;
    d) a VL2 comprising a CDRL1, a CDRL2, and a CDRL3 selected from the group consisting of SEQ ID NOs: 76, 77, and 6780, respectively; and a VH2 comprising a CDRH1, a CDRH2, and a CDRH3 selected from the group consisting of SEQ ID NOs: 154, 155, and 156, respectively;
    e) a VL2 comprising a CDRL1, a CDRL2, and a CDRL3 selected from the group consisting of SEQ ID NOs: 82, 83, and 84, respectively; and a VH2 comprising a CDRH1, a CDRH2, and a CDRH3 selected from the group consisting of SEQ ID NOs: 160, 161, and 162, respectively;
    f) a VL2 comprising a CDRL1, a CDRL2, and a CDRL3 selected from the group consisting of SEQ ID NOs: 88, 89, and 90, respectively; and a VH2 comprising a CDRH1, a CDRH2, and a CDRH3 selected from the group consisting of SEQ ID NOs: 166, 167, and 168, respectively;
    g) a VL2 comprising a CDRL1, a CDRL2, and a CDRL3 selected from the group consisting of SEQ ID NOs: 94, 95, and 96, respectively; and a VH2 comprising a CDRH1, a CDRH2, and a CDRH3 selected from the group consisting of SEQ ID NOs: 172, 173, and 174, respectively;
    h) a VL2 comprising a CDRL1, a CDRL2, and a CDRL3 selected from the group consisting of SEQ ID NOs: 100, 101, and 102, respectively; and a VH2 comprising a CDRH1, a CDRH2, and a CDRH3 selected from the group consisting of SEQ ID NOs: 178, 179, and 180, respectively;
    i) a VL2 comprising a CDRL1, a CDRL2, and a CDRL3 selected from the group consisting of SEQ ID NOs: 106, 107, and 108, respectively; and a VH2 comprising a CDRH1, a CDRH2, and a CDRH3 selected from the group consisting of SEQ ID NOs: 184, 185, and 186, respectively;
    j) a VL2 comprising a CDRL1, a CDRL2, and a CDRL3 selected from the group consisting of SEQ ID NOs: 112, 113, and 114, respectively; and a VH2 comprising a CDRH1, a CDRH2, and a CDRH3 selected from the group consisting of SEQ ID NOs: 190, 191, and 192, respectively;
    k) a VL2 comprising a CDRL1, a CDRL2, and a CDRL3 selected from the group consisting of SEQ ID NOs: 118, 119, and 120, respectively; and a VH2 comprising a CDRH1, a CDRH2, and a CDRH3 selected from the group consisting of SEQ ID NOs: 196, 197, and 198, respectively;

l) a VL2 comprising a CDRL1, a CDRL2, and a CDRL3 selected from the group consisting of SEQ ID NOs: 124, 125, and 126, respectively; and a VH2 comprising a CDRH1, a CDRH2, and a CDRH3 selected from the group consisting of SEQ ID NOs: 202, 203, and 204, respectively; and m) a VL2 comprising a CDRL1, a CDRL2, and a CDRL3 selected from the group consisting of SEQ ID NOs: 130, 131, and 132, respectively; and a VH2 comprising a CDRH1, a CDRH2, and a CDRH3 selected from the group consisting of SEQ ID NOs: 208, 209, and 210, respectively.

In one embodiment:

the VL1 comprises an amino acid sequence selected from the group consisting of SEQ ID NO: 213, 217, 221, and 225;

the VH1 comprises an amino acid sequence selected from the group consisting of SEQ ID NO: 214, 218, 222, and 226;

the VL2 comprises an amino acid sequence selected from the group consisting of SEQ ID NOs: 5, 9, 13, 17, 21, 25, 29, 33, 37, 41, 45, 49, and 53; and the VH2 comprises an amino acid sequence selected from the group consisting of SEQ ID NO: 6, 10, 14, 18, 22, 26, 30, 34, 38, 42, 46, 50, and 54.

In one embodiment:

1) the VL1 and VH1 are selected from the group consisting of:
   a) a VL1 comprising SEQ ID NO: 213 and a VH1 comprising SEQ ID NO: 214;
   b) a VL1 comprising SEQ ID NO: 217 and a VH1 comprising SEQ ID NO: 218;
   c) a VL1 comprising SEQ ID NO: 221 and a VH1 comprising SEQ ID NO: 222; and
   d) a VL1 comprising SEQ ID NO: 225 and a VH1 comprising SEQ ID NO: 226;
and 2) the VL2 and VH2 are selected from the group consisting of:
   a) a VL2 comprising SEQ ID NO: 5 and a VH2 comprising SEQ ID NO: 6;
   b) a VL2 comprising SEQ ID NO: 9 and a VH2 comprising SEQ ID NO: 10;
   c) a VL2 comprising SEQ ID NO: 13 and a VH2 comprising SEQ ID NO: 14;
   d) a VL2 comprising SEQ ID NO: 17 and a VH2 comprising SEQ ID NO: 18;
   e) a VL2 comprising SEQ ID NO: 21 and a VH2 comprising SEQ ID NO: 22;
   f) a VL2 comprising SEQ ID NO: 25 and a VH2 comprising SEQ ID NO: 26;
   g) a VL2 comprising SEQ ID NO: 29 and a VH2 comprising SEQ ID NO: 30;
   h) a VL2 comprising SEQ ID NO: 33 and a VH2 comprising SEQ ID NO: 34;
   i) a VL2 comprising SEQ ID NO: 37 and a VH2 comprising SEQ ID NO: 38;
   j) a VL2 comprising SEQ ID NO: 41 and a VH2 comprising SEQ ID NO: 42;
   k) a VL2 comprising SEQ ID NO: 45 and a VH2 comprising SEQ ID NO: 46;
   l) a VL2 comprising SEQ ID NO: 49 and a VH2 comprising SEQ ID NO: 50; and
   m) a VL2 comprising SEQ ID NO: 53 and a VH2 comprising SEQ ID NO: 54.

In one embodiment, the CL of the light chain is selected from the group consisting of SEQ ID NO: 883 and SEQ ID NO: 884.

In one embodiment, the CH1-hinge-CH2-CH3 of the heavy chain is selected from the group consisting of SEQ ID NO: 885 and SEQ ID NO: 886.

In one embodiment, the first peptide linker is selected from the group consisting of SEQ ID NOs: 888-893.

In one embodiment, the second peptide linker is selected from the group consisting of SEQ ID NOs: 887-893.

In one embodiment, the first peptide linker comprises SEQ ID NO: 889 and the second peptide linker comprises SEQ ID NO: 887.

In one embodiment, the light chain comprises a sequence selected from the group consisting of SEQ ID NOs: 382, 386, 390, 394, 398, 402, 406, 410, 414, 418, 422, 426, 430, 434, 438, 442, 446, and 450; and the heavy chain fusion protein comprises a sequence selected from the group consisting of SEQ ID NOs: 381, 385, 389, 393, 397, 401, 405, 409, 413, 417, 421, 425, 429, 433, 437, 441, 445, and 449.

In one embodiment, the light chain and the heavy chain fusion protein comprise polypeptides comprising amino acid sequences selected from the group consisting of:
SEQ ID NO: 382 and SEQ ID NO: 381, respectively;
SEQ ID NO: 386 and SEQ ID NO: 385, respectively;
SEQ ID NO: 390 and SEQ ID NO: 389, respectively;
SEQ ID NO: 394 and SEQ ID NO: 393, respectively;
SEQ ID NO: 398 and SEQ ID NO: 397, respectively;
SEQ ID NO: 402 and SEQ ID NO: 401, respectively;
SEQ ID NO: 406 and SEQ ID NO: 405, respectively;
SEQ ID NO: 410 and SEQ ID NO: 409, respectively;
SEQ ID NO: 414 and SEQ ID NO: 413, respectively;
SEQ ID NO: 418 and SEQ ID NO: 417, respectively;
SEQ ID NO: 422 and SEQ ID NO: 421, respectively;
SEQ ID NO: 426 and SEQ ID NO: 425, respectively;
SEQ ID NO: 430 and SEQ ID NO: 429, respectively;
SEQ ID NO: 434 and SEQ ID NO: 433, respectively;
SEQ ID NO: 438 and SEQ ID NO: 437, respectively;
SEQ ID NO: 442 and SEQ ID NO: 441, respectively;
SEQ ID NO: 446 and SEQ ID NO: 445, respectively; and
SEQ ID NO: 450 and SEQ ID NO: 449, respectively.

In one embodiment, the CL of the light chain is selected from the group consisting of SEQ ID NO: 883 and SEQ ID NO: 884.

In one embodiment, the CH1-hinge-CH2-CH3 of the heavy chain is selected from the group consisting of SEQ ID NO: 885 and SEQ ID NO: 886.

In one embodiment, the first peptide linker is selected from the group consisting of SEQ ID NOs: 888-893.

In one embodiment, the second peptide linker is selected from the group consisting of SEQ ID NOs: 887-893.

In one embodiment, the first peptide linker comprises SEQ ID NO: 889 and the second peptide linker comprises SEQ ID NO: 887.

The term "monoclonal antibody" (mAb) or monoclonal antibody construct as used herein refers to an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts. Monoclonal antibodies are highly specific, being directed against a single antigenic site or determinant on the antigen, in contrast to conventional (polyclonal) antibody preparations which typically include different antibodies directed against different determinants (or epitopes). In addition to their specificity, the monoclonal antibodies are advantageous in that they are synthesized by the hybridoma culture, hence uncontaminated by other immunoglobulins. The modifier "monoclonal" indicates the character of the antibody as being obtained from a substantially homogeneous population of antibodies, and is not to be construed as requiring production of the antibody by any particular method.

For the preparation of monoclonal antibodies, any technique providing antibodies produced by continuous cell line cultures can be used. For example, monoclonal antibodies to be used may be made by the hybridoma method first described by Koehler et al., Nature, 256: 495 (1975), or may be made by recombinant DNA methods (see, e.g., U.S. Pat. No. 4,816,567). Examples for further techniques to produce human monoclonal antibodies include the trioma technique, the human B-cell hybridoma technique (Kozbor, Immunology Today 4 (1983), 72) and the EBV-hybridoma technique (Cole et al., Monoclonal Antibodies and Cancer Therapy, Alan R. Liss, Inc. (1985), 77-96).

Hybridomas can then be screened using standard methods, such as enzyme-linked immunosorbent assay (ELISA) and surface plasmon resonance (BIACORE™) analysis, to identify one or more hybridomas that produce an antibody that specifically binds with a specified antigen. Any form of the relevant antigen may be used as the immunogen, e.g., recombinant antigen, naturally occurring forms, any variants or fragments thereof, as well as an antigenic peptide thereof. Surface plasmon resonance as employed in the BIAcore system can be used to increase the efficiency of phage antibodies which bind to an epitope of a target antigen, such as MSLN or CD40 (Schier, Human Antibodies Hybridomas 7 (1996), 97-105; Malmborg, J. Immunol. Methods 183 (1995), 7-13).

Another exemplary method of making monoclonal antibodies includes screening protein expression libraries, e.g., phage display or ribosome display libraries. Phage display is described, for example, in Ladner et al., U.S. Pat. No. 5,223,409; Smith (1985) Science 228:1315-1317, Clackson et al., Nature, 352: 624-628 (1991) and Marks et al., J. Mol. Biol., 222: 581-597 (1991).

In addition to the use of display libraries, the relevant antigen can be used to immunize a non-human animal, e.g., a rodent (such as a mouse, hamster, rabbit or rat). In one embodiment, the non-human animal includes at least a part of a human immunoglobulin gene. For example, it is possible to engineer mouse strains deficient in mouse antibody production with large fragments of the human Ig (immunoglobulin) loci. Using the hybridoma technology, antigen-specific monoclonal antibodies derived from the genes with the desired specificity may be produced and selected. See, e.g., XENOMOUSE™, Green et al. (1994) Nature Genetics 7:13-21, US 2003-0070185, WO 96/34096, and WO 96/33735.

A monoclonal antibody can also be obtained from a non-human animal, and then modified, e.g., humanized, deimmunized, rendered chimeric etc., using recombinant DNA techniques known in the art. Examples of modified antibody constructs include humanized variants of non-human antibodies, "affinity matured" antibodies (see, e.g. Hawkins et al. J. Mol. Biol. 254, 889-896 (1992) and Lowman et al., Biochemistry 30, 10832-10837 (1991)) and antibody mutants with altered effector function(s) (see, e.g., U.S. Pat. No. 5,648,260, Kontermann and Dubel (2010), loc. cit. and Little (2009), loc. cit).

In immunology, affinity maturation is the process by which B cells produce antibodies with increased affinity for antigen during the course of an immune response. With repeated exposures to the same antigen, a host will produce antibodies of successively greater affinities. Like the natural prototype, the in vitro affinity maturation is based on the principles of mutation and selection. The in vitro affinity maturation has successfully been used to optimize antibodies, antibody constructs, and antibody fragments. Random mutations inside the CDRs are introduced using radiation, chemical mutagens or error-prone PCR. In addition, the genetical diversity can be increased by chain shuffling. Two or three rounds of mutation and selection using display methods like phage display usually results in antibody fragments with affinities in the low nanomolar range.

A preferred type of an amino acid substitutional variation of the antibody constructs involves substituting one or more hypervariable region residues of a parent antibody (e g a humanized or human antibody). Generally, the resulting variant(s) selected for further development will have improved biological properties relative to the parent antibody from which they are generated. A convenient way for generating such substitutional variants involves affinity maturation using phage display. Briefly, several hypervariable region sites (e. g. 6-7 sites) are mutated to generate all possible amino acid substitutions at each site. The antibody variants thus generated are displayed in a monovalent fashion from filamentous phage particles as fusions to the gene III product of M13 packaged within each particle. The phage-displayed variants are then screened for their biological activity (e. g. binding affinity) as herein disclosed. In order to identify candidate hypervariable region sites for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the binding domain and, e.g., human MSLN. Such contact residues and neighboring residues are candidates for substitution according to the techniques elaborated herein. Once such variants are generated, the panel of variants is subjected to screening as described herein and antibodies with superior properties in one or more relevant assays may be selected for further development.

The monoclonal antibodies and antibody constructs of the present invention specifically include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is/are identical with or homologous to corresponding sequences in antibodies derived from another species or belonging to another antibody class or subclass, as well as fragments of such antibodies, so long as they exhibit the desired biological activity (U.S. Pat. No. 4,816,567; Morrison et al., Proc. Natl. Acad. Sci. USA, 81: 6851-6855 (1984)). Chimeric antibodies of interest herein include "primitized" antibodies comprising variable domain antigen-binding sequences derived from a non-human primate (e.g., Old World Monkey, Ape etc.) and human constant region sequences. A variety of approaches for making chimeric antibodies have been described. See e.g., Morrison et al., Proc. Natl. Acad. ScL U.S.A. 81:6851, 1985; Takeda et al., Nature 314:452, 1985, Cabilly et al., U.S. Pat. No. 4,816,567; Boss et al., U.S. Pat. No. 4,816,397; Tanaguchi et al., EP 0171496; EP 0173494; and GB 2177096.

An antibody, antibody construct, antibody fragment or antibody variant may also be modified by specific deletion of human T cell epitopes (a method called "deimmunization") by the methods disclosed for example in WO 98/52976 or WO 00/34317. Briefly, the heavy and light chain variable domains of an antibody can be analyzed for peptides that bind to MHC class II; these peptides represent potential T cell epitopes (as defined in WO 98/52976 and WO 00/34317). For detection of potential T cell epitopes, a computer modeling approach termed "peptide threading" can be applied, and in addition a database of human MHC class II binding peptides can be searched for motifs present in the VH and VL sequences, as described in WO 98/52976 and WO 00/34317. These motifs bind to any of the 18 major MHC class II DR allotypes, and thus constitute potential T cell epitopes. Potential T cell epitopes detected can be eliminated by substituting small numbers of amino acid residues in the variable domains, or preferably, by single amino acid substitutions. Typically, conservative substitutions are made. Often, but not exclusively, an amino acid common to a position in human germline antibody sequences may be used. Human germline sequences are disclosed e.g. in Tomlinson, et al. (1992) J. Mol. Biol. 227:776-798; Cook, G. P. et al. (1995) Immunol. Today Vol. 16 (5): 237-242; and Tomlinson et al. (1995) EMBO J. 14: 14:4628-4638. The V BASE directory provides a comprehensive directory of human immunoglobulin variable region sequences (compiled by Tomlinson, L A. et al. MRC Centre for Protein Engineering, Cambridge, UK). These sequences can be used as a source of human sequence, e.g., for framework regions and CDRs. Consensus human framework regions can also be used, for example as described in U.S. Pat. No. 6,300,064.

"Humanized" antibodies, antibody constructs, variants or fragments thereof (such as Fv, Fab, Fab', F(ab')2 or other antigen-binding subsequences of antibodies) are antibodies or immunoglobulins of mostly human sequences, which contain (a) minimal sequence(s) derived from non-human immunoglobulin. For the most part, humanized antibodies are human immunoglobulins (recipient antibody) in which residues from a hypervariable region (also CDR) of the recipient are replaced by residues from a hypervariable region of a non-human (e g, rodent) species (donor antibody) such as mouse, rat, hamster or rabbit having the desired specificity, affinity, and capacity. In some instances, Fv framework region (FR) residues of the human immunoglobulin are replaced by corresponding non-human residues. Furthermore, "humanized antibodies" as used herein may also comprise residues which are found neither in the recipient antibody nor the donor antibody. These modifications are made to further refine and optimize antibody performance. The humanized antibody may also comprise at least a portion of an immunoglobulin constant region (Fc), typically that of a human immunoglobulin. For further details, see Jones et al., Nature, 321: 522-525 (1986); Reichmann et al., Nature, 332: 323-329 (1988); and Presta, Curr. Op. Struct. Biol., 2: 593-596 (1992).

Humanized antibodies or fragments thereof can be generated by replacing sequences of the Fv variable domain that are not directly involved in antigen binding with equivalent sequences from human Fv variable domains. Exemplary methods for generating humanized antibodies or fragments thereof are provided by Morrison (1985) Science 229:1202-1207; by Oi et al. (1986) BioTechniques 4:214; and by U.S. Pat. Nos. 5,585,089; 5,693,761; 5,693,762; 5,859,205; and 6,407,213. Those methods include isolating, manipulating, and expressing the nucleic acid sequences that encode all or part of immunoglobulin Fv variable domains from at least one of a heavy or light chain Such nucleic acids may be obtained from a hybridoma producing an antibody against a predetermined target, as described above, as well as from other sources. The recombinant DNA encoding the humanized antibody molecule can then be cloned into an appropriate expression vector.

Humanized antibodies may also be produced using transgenic animals such as mice that express human heavy and light chain genes, but are incapable of expressing the endogenous mouse immunoglobulin heavy and light chain genes. Winter describes an exemplary CDR grafting method that may be used to prepare the humanized antibodies described herein (U.S. Pat. No. 5,225,539). All of the CDRs of a particular human antibody may be replaced with at least a portion of a non-human CDR, or only some of the CDRs may be replaced with non-human CDRs. It is only necessary to replace the number of CDRs required for binding of the humanized antibody to a predetermined antigen.

A humanized antibody can be optimized by the introduction of conservative substitutions, consensus sequence substitutions, germline substitutions and/or back mutations. Such altered immunoglobulin molecules can be made by any of several techniques known in the art, (e.g., Teng et al., Proc. Natl. Acad. Sci. U.S.A., 80: 7308-7312, 1983; Kozbor et al., Immunology Today, 4: 7279, 1983; Olsson et al, Meth. Enzymol., 92: 3-16, 1982, and EP 239 400).

The term "human antibody", "human antibody construct" and "human binding domain" includes antibodies, antibody constructs and binding domains having antibody regions such as variable and constant regions or domains which correspond substantially to human germline immunoglobulin sequences known in the art, including, for example, those described by Kabat et al. (1991) (loc. cit.). The human antibodies, antibody constructs or binding domains of the invention may include amino acid residues not encoded by human germline immunoglobulin sequences (e.g., mutations introduced by random or site-specific mutagenesis in vitro or by somatic mutation in vivo), for example in the CDRs, and in particular, in CDR3. The human antibodies, antibody constructs or binding domains can have at least one, two, three, four, five, or more positions replaced with an amino acid residue that is not encoded by the human germline immunoglobulin sequence. The definition of human antibodies, antibody constructs and binding domains as used herein also contemplates fully human antibodies, which include only non-artificially and/or genetically altered human sequences of antibodies as those can be derived by using technologies or systems such as the Xenomouse.

In some embodiments, the antibody constructs of the invention are "isolated" or "substantially pure" antibody constructs. "Isolated" or "substantially pure", when used to describe the antibody constructs disclosed herein, means an antibody construct that has been identified, separated and/or recovered from a component of its production environment. Preferably, the antibody construct is free or substantially free of association with all other components from its production environment. Contaminant components of its production environment, such as that resulting from recombinant transfected cells, are materials that would typically interfere with diagnostic or therapeutic uses for the polypeptide, and may include enzymes, hormones, and other proteinaceous or non-proteinaceous solutes. The antibody constructs may e.g constitute at least about 5%, or at least about 50% by weight of the total protein in a given sample. It is understood that the isolated protein may constitute from 5% to 99.9% by weight of the total protein content, depending on the circumstances. The polypeptide may be made at a significantly higher concentration through the use of an inducible promoter or high expression promoter, such that it is made at increased concentration levels. The definition includes the production of an antibody construct in a wide variety of organisms and/or host cells that are known in the art. In preferred embodiments, the antibody construct will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Ordinarily, however, an isolated antibody construct will be prepared by at least one purification step.

The term "binding domain" characterizes in connection with the present invention a domain which (specifically) binds to/interacts with/recognizes a given target epitope or a given target site on the target molecules (antigens), here: MSLN and CD40, respectively. The structure and function of the one binding domain (recognizing MSLN), and preferably also the structure and/or function of another binding domain (recognizing CD40), is/are based on the structure and/or function of an antibody, e.g. of a full-length or whole immunoglobulin molecule. According to the invention, the binding domains are characterized by the presence of three light chain CDRs (i.e. CDRL1, CDRL2 and CDRL3 of the VL region) and/or three heavy chain CDRs (i.e. CDRH1, CDRH2 and CDRH3 of the VH region). It is envisaged that the binding domains are produced by or obtainable by phage-display or library screening methods rather than by grafting CDR sequences from a pre-existing (monoclonal) antibody into a scaffold. According to the present invention, binding domains are in the form of one or more polypeptides. Such polypeptides may include proteinaceous parts and non-proteinaceous parts (e.g. chemical linkers or chemical cross-linking agents such as glutaraldehyde). Proteins (including fragments thereof, preferably biologically active fragments, and peptides, usually having less than 30 amino acids) comprise two or more amino acids coupled to each other via a covalent peptide bond (resulting in a chain of amino acids). The term "polypeptide" as used herein describes a group of molecules, which usually consist of more than 30 amino acids. Polypeptides may further form multimers such as dimers, trimers and higher oligomers, i.e., consisting of more than one polypeptide molecule. Polypeptide molecules forming such dimers, trimers etc. may be identical or non-identical. The corresponding higher order structures of such multimers are, consequently, termed homo- or heterodimers, homo- or heterotrimers etc. An example for a hereteromultimer is an antibody molecule, which, in its naturally occurring form, consists of two identical light polypeptide chains and two identical heavy polypeptide chains. The terms "peptide", "polypeptide" and "protein" also refer to naturally modified peptides/polypeptides/proteins wherein the modification is effected e.g. by post-translational modifications like glycosylation, acetylation, phosphorylation and the like. A "peptide", "polypeptide" or "protein" when referred to herein may also be chemically modified such as pegylated. Such modifications are well known in the art and described herein below.

Preferably the binding domain which binds to MSLN and/or the binding domain which binds to CD40 is/are human binding domains. Antibodies and antibody constructs comprising at least one human binding domain avoid some of the problems associated with antibodies or antibody constructs that possess non-human such as rodent (e.g. murine, rat, hamster or rabbit) variable and/or constant regions. The presence of such rodent derived proteins can lead to the rapid clearance of the antibodies or antibody constructs or can lead to the generation of an immune response against the antibody or antibody construct by a patient. In order to avoid the use of rodent derived antibodies or antibody constructs, human or fully human antibodies/antibody constructs can be generated through the introduction of human antibody function into a rodent so that the rodent produces fully human antibodies.

The ability to clone and reconstruct megabase-sized human loci in YACs and to introduce them into the mouse germline provides a powerful approach to elucidating the functional components of very large or crudely mapped loci as well as generating useful models of human disease. Furthermore, the use of such technology for substitution of mouse loci with their human equivalents could provide unique insights into the expression and regulation of human gene products during development, their communication with other systems, and their involvement in disease induction and progression.

An important practical application of such a strategy is the "humanization" of the mouse humoral immune system. Introduction of human immunoglobulin (Ig) loci into mice in which the endogenous Ig genes have been inactivated offers the opportunity to study the mechanisms underlying programmed expression and assembly of antibodies as well as their role in B-cell development. Furthermore, such a strategy could provide an ideal source for production of fully human monoclonal antibodies (mAbs)—an important milestone towards fulfilling the promise of antibody therapy in human disease. Fully human antibodies or antibody constructs are expected to minimize the immunogenic and allergic responses intrinsic to mouse or mouse-derivatized mAbs and thus to increase the efficacy and safety of the administered antibodies/antibody constructs. The use of fully human antibodies or antibody constructs can be expected to provide a substantial advantage in the treatment of chronic and recurring human diseases, such as inflammation, autoimmunity, and cancer, which require repeated compound administrations.

One approach towards this goal was to engineer mouse strains deficient in mouse antibody production with large fragments of the human Ig loci in anticipation that such mice would produce a large repertoire of human antibodies in the absence of mouse antibodies. Large human Ig fragments would preserve the large variable gene diversity as well as the proper regulation of antibody production and expression. By exploiting the mouse machinery for antibody diversification and selection and the lack of immunological tolerance to human proteins, the reproduced human antibody repertoire in these mouse strains should yield high affinity antibodies against any antigen of interest, including human antigens. Using the hybridoma technology, antigen-specific human mAbs with the desired specificity could be readily produced and selected. This general strategy was demonstrated in connection with the generation of the first Xeno-Mouse mouse strains (see Green et al. Nature Genetics 7:13-21 (1994)). The XenoMouse strains were engineered with yeast artificial chromosomes (YACs) containing 245 kb and 190 kb-sized germline configuration fragments of the human heavy chain locus and kappa light chain locus, respectively, which contained core variable and constant region sequences. The human Ig containing YACs proved to be compatible with the mouse system for both rearrangement and expression of antibodies and were capable of substituting for the inactivated mouse Ig genes. This was demonstrated by their ability to induce B cell development, to produce an adult-like human repertoire of fully human antibodies, and to generate antigen-specific human mAbs. These results also suggested that introduction of larger portions of the human Ig loci containing greater numbers of V genes, additional regulatory elements, and human Ig constant regions might recapitulate substantially the full repertoire that is characteristic of the human humoral response to infection and immunization. The work of Green et al. was recently extended to the introduction of greater than approximately 80% of the human antibody repertoire through introduction of megabase sized, germline configuration YAC fragments of the human heavy chain loci and kappa light chain loci, respectively. See Mendez et al. Nature Genetics 15:146-156 (1997) and U.S. patent application Ser. No. 08/759,620.

The production of the XenoMouse mice is further discussed and delineated in U.S. patent application Ser. No. 07/466,008, Ser. No. 07/610,515, Ser. No. 07/919,297, Ser. No. 07/922,649, Ser. No. 08/031,801, Ser. No. 08/112,848, Ser. No. 08/234,145, Ser. No. 08/376,279, Ser. No. 08/430, 938, Ser. No. 08/464,584, Ser. No. 08/464,582, Ser. No. 08/463,191, Ser. No. 08/462,837, Ser. No. 08/486,853, Ser. No. 08/486,857, Ser. No. 08/486,859, Ser. No. 08/462,513, Ser. No. 08/724,752, and Ser. No. 08/759,620; and U.S. Pat. Nos. 6,162,963; 6,150,584; 6,114,598; 6,075,181, and 5,939,598 and Japanese Patent Nos. 3 068 180 B2, 3 068 506 B2, and 3 068 507 B2. See also Mendez et al. Nature Genetics 15:146-156 (1997) and Green and Jakobovits J. Exp. Med. 188:483-495 (1998), EP 0 463 151 B1, WO 94/02602, WO 96/34096, WO 98/24893, WO 00/76310, and WO 03/47336.

In an alternative approach, others, including GenPharm International, Inc., have utilized a "minilocus" approach. In the minilocus approach, an exogenous Ig locus is mimicked through the inclusion of pieces (individual genes) from the Ig locus. Thus, one or more VH genes, one or more DH genes, one or more JH genes, a mu constant region, and a second constant region (preferably a gamma constant region) are formed into a construct for insertion into an animal. This approach is described in U.S. Pat. No. 5,545, 807 to Surani et al. and U.S. Pat. Nos. 5,545,806; 5,625,825; 5,625,126; 5,633,425; 5,661,016; 5,770,429; 5,789,650; 5,814,318; 5,877,397; 5,874,299; and 6,255,458 each to Lonberg and Kay, U.S. Pat. Nos. 5,591,669 and 6,023,010 to Krimpenfort and Berns, U.S. Pat. Nos. 5,612,205; 5,721, 367; and 5,789,215 to Berns et al., and U.S. Pat. No. 5,643,763 to Choi and Dunn, and GenPharm International U.S. patent application Ser. No. 07/574,748, Ser. No. 07/575,962, Ser. No. 07/810,279, Ser. No. 07/853,408, Ser. No. 07/904,068, Ser. No. 07/990,860, Ser. No. 08/053,131, Ser. No. 08/096,762, Ser. No. 08/155,301, Ser. No. 08/161, 739, Ser. No. 08/165,699, Ser. No. 08/209,741. See also EP 0 546 073 B1, WO 92/03918, WO 92/22645, WO 92/22647, WO 92/22670, WO 93/12227, WO 94/00569, WO 94/25585, WO 96/14436, WO 97/13852, and WO 98/24884 and U.S. Pat. No. 5,981,175. See further Taylor et al. (1992), Chen et al. (1993), Tuaillon et al. (1993), Choi et al. (1993), Lonberg et al. (1994), Taylor et al. (1994), and Tuaillon et al. (1995), Fishwild et al. (1996).

Kirin has also demonstrated the generation of human antibodies from mice in which, through microcell fusion, large pieces of chromosomes, or entire chromosomes, have been introduced. See European Patent Application Nos. 773 288 and 843 961. Xenerex Biosciences is developing a technology for the potential generation of human antibodies. In this technology, SCID mice are reconstituted with human lymphatic cells, e.g., B and/or T cells. Mice are then immunized with an antigen and can generate an immune response against the antigen. See U.S. Pat. Nos. 5,476,996; 5,698,767; and 5,958,765.

Human anti-mouse antibody (HAMA) responses have led the industry to prepare chimeric or otherwise humanized antibodies. It is however expected that certain human anti-chimeric antibody (HACA) responses will be observed, particularly in chronic or multi-dose utilizations of the antibody. Thus, it would be desirable to provide antibody constructs comprising a human binding domain against MSLN and a human binding domain against CD40 in order to vitiate concerns and/or effects of HAMA or HACA response.

The terms "(specifically) binds to", (specifically) recognizes", "is (specifically) directed to", and "(specifically) reacts with" mean in accordance with this invention that a binding domain interacts or specifically interacts with a given epitope or a given target site on the target molecules (antigens), here: MSLN and CD40, respectively.

The term "epitope" refers to a site on an antigen to which a binding domain, such as an antibody or immunoglobulin, or a derivative, fragment or variant of an antibody or an immunoglobulin, specifically binds. An "epitope" is antigenic and thus the term epitope is sometimes also referred to herein as "antigenic structure" or "antigenic determinant" Thus, the binding domain is an "antigen interaction site". Said binding/interaction is also understood to define a "specific recognition".

"Epitopes" can be formed both by contiguous amino acids or non-contiguous amino acids juxtaposed by tertiary folding of a protein. A "linear epitope" is an epitope where an amino acid primary sequence comprises the recognized epitope. A linear epitope typically includes at least 3 or at least 4, and more usually, at least 5 or at least 6 or at least 7, for example, about 8 to about 10 amino acids in a unique sequence.

A "conformational epitope", in contrast to a linear epitope, is an epitope wherein the primary sequence of the amino acids comprising the epitope is not the sole defining component of the epitope recognized (e.g., an epitope wherein the primary sequence of amino acids is not necessarily recognized by the binding domain) Typically a conformational epitope comprises an increased number of amino acids relative to a linear epitope. With regard to recognition of conformational epitopes, the binding domain recognizes a three-dimensional structure of the antigen, preferably a peptide or protein or fragment thereof (in the context of the present invention, the antigenic structure for one of the binding domains is comprised within the MSLN protein). For example, when a protein molecule folds to form a three-dimensional structure, certain amino acids and/or the polypeptide backbone forming the conformational epitope become juxtaposed enabling the antibody to recognize the epitope. Methods of determining the conformation of epitopes include, but are not limited to, x-ray crystallography, two-dimensional nuclear magnetic resonance (2D-NMR) spectroscopy and site-directed spin labelling and electron paramagnetic resonance (EPR) spectroscopy.

A method for epitope mapping is described in the following: When a region (a contiguous amino acid stretch) in the human MSLN protein is exchanged/replaced with its corresponding region of a non-human and non-primate MSLN antigen (e.g., mouse MSLN, but others like chicken, rat, hamster, rabbit etc. might also be conceivable), a decrease in the binding of the binding domain is expected to occur, unless the binding domain is cross-reactive for the non-human, non-primate MSLN used. Said decrease is preferably at least 10%, 20%, 30%, 40%, or 50%; more preferably at least 60%, 70%, or 80%, and most preferably 90%, 95% or even 100% in comparison to the binding to the respective region in the human MSLN protein, whereby binding to the respective region in the human MSLN protein is set to be 100%. It is envisaged that the aforementioned human MSLN/non-human MSLN chimeras are expressed in CHO cells. The human MSLN/non-human MSLN chimeras may also be fused with a transmembrane domain and/or cytoplasmic domain of a different membrane-bound protein such as EpCAM, although such technique was not necessary for the method described in Examples 1 and 2.

In an alternative or additional method for epitope mapping, several truncated versions of the human MSLN extracellular domain can be generated in order to determine a specific region that is recognized by a binding domain. In these truncated versions, the different extracellular MSLN domains/sub-domains or regions are stepwise deleted, starting from the N-terminus. The truncated MSLN versions that may be expressed in CHO cells. It is also envisaged that the truncated MSLN versions may be fused with a transmembrane domain and/or cytoplasmic domain of a different membrane-bound protein such as EpCAM. It is also envisaged that the truncated MSLN versions may encompass a signal peptide domain at their N-terminus, for example a signal peptide derived from mouse IgG heavy chain signal peptide. It is furthermore envisaged that the truncated MSLN versions may encompass a v5 domain at their N-terminus (following the signal peptide) which allows verifying their correct expression on the cell surface. A decrease or a loss of binding is expected to occur with those truncated MSLN versions which do not encompass any more the MSLN region that is recognized by the binding domain. The decrease of binding is preferably at least 10%, 20%, 30%, 40%, 50%; more preferably at least 60%, 70%, 80%, and most preferably 90%, 95% or even 100%, whereby binding to the entire human MSLN protein (or its extracellular region or domain) is set to be 100%.

A further method to determine the contribution of a specific residue of a target antigen to the recognition by a antibody construct or binding domain is alanine scanning (see e.g. Morrison K L & Weiss G A. Cur Opin Chem Biol. 2001 June; 5(3):302-7), where each residue to be analyzed is replaced by alanine, e.g. via site-directed mutagenesis Alanine is used because of its non-bulky, chemically inert, methyl functional group that nevertheless mimics the secondary structure references that many of the other amino acids possess. Sometimes bulky amino acids such as valine or leucine can be used in cases where conservation of the size of mutated residues is desired Alanine scanning is a mature technology which has been used for a long period of time.

The interaction between the binding domain and the epitope or the region comprising the epitope implies that a binding domain exhibits appreciable affinity for the epitope/the region comprising the epitope on a particular protein or antigen (here: MSLN and CD40, respectively) and, generally, does not exhibit significant reactivity with proteins or antigens other than MSLN or CD40. "Appreciable affinity" includes binding with an affinity of about $10^{-6}$ M (KD) or stronger. Preferably, binding is considered specific when the binding affinity is about $10^{-12}$ to $10^{0-8}$ M, $10^{-12}$ to $10^{-9}$M, $10^{-12}$ to $10^{-10}$ M, $10^{-11}$ to $10^{-6}$ M, preferably of about $10^{41}$ to $10^{-9}$ M. Whether a binding domain specifically reacts with or binds to a target can be tested readily by, inter alia, comparing the reaction of said binding domain with a target protein or antigen with the reaction of said binding domain with proteins or antigens other than MSLN or CD40. Preferably, a binding domain of the invention does not essentially or substantially bind to proteins or antigens other than MSLN or CD40 (e.g., one binding domain is not capable of binding to proteins other than MSLN and the other binding domain is not capable of binding to proteins other than CD40).

The term "does not essentially/substantially bind" or "is not capable of binding" means that a binding domain of the present invention does not bind a protein or antigen other than MSLN or CD40, i.e., does not show reactivity of more than 30%, preferably not more than 20%, more preferably not more than 10%, particularly preferably not more than 9%, 8%, 7%, 6% or 5% with proteins or antigens other than MSLN or CD40, whereby binding to MSLN or CD40, respectively, is set to be 100%.

Specific binding is believed to be effected by specific motifs in the amino acid sequence of the binding domain and the antigen. Thus, binding is achieved as a result of their primary, secondary and/or tertiary structure as well as the result of secondary modifications of said structures. The specific interaction of the antigen-interaction-site with its specific antigen may result in a simple binding of said site to the antigen. Moreover, the specific interaction of the antigen-interaction-site with its specific antigen may alternatively or additionally result in the initiation of a signal, e.g. due to the induction of a change of the conformation of the antigen, an oligomerization of the antigen, etc.

The Fc region of an antibody interacts with a number of Fc receptors and ligands, imparting an array of important functional capabilities referred to as effector functions. For IgG the Fc region comprises Ig domains CH2 and CH3. An important family of Fc receptors for the IgG isotype are the Fc gamma receptors (FcγRs). These receptors mediate communication between antibodies and the cellular arm of the immune system. In humans this protein family includes FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIIb-NA1 and FcγRIIIb-NA2) (Jefferis et al., 2002, Immunol Lett 82:57-65). These receptors typically have an extracellular domain that mediates binding to Fc, a membrane spanning region, and an intracellular domain that may mediate some signaling event within the cell. These receptors are expressed in a variety of immune cells including monocytes, macrophages, neutrophils, dendritic cells, eosinophils, mast cells, platelets, B cells, large granular lymphocytes, Langerhans' cells, natural killer (NK) cells, and γδ T cells. Formation of the Fc/FcγR complex recruits these effector cells to sites of bound antigen, typically resulting in signaling events within the cells and important subsequent immune responses such as release of inflammation mediators, B cell activation, endocytosis, phagocytosis, and cytotoxic attack. The ability to mediate cytotoxic and phagocytic effector functions is a potential mechanism by which antibodies destroy targeted cells. The cell-mediated reaction wherein nonspecific cytotoxic cells that express FcγRs recognize bound antibody on a target cell and subsequently cause lysis of the target cell is referred to as antibody dependent cell-mediated cytotoxicity (ADCC). The cell-mediated reaction wherein nonspecific cytotoxic cells that express FcγRs recognize bound antibody on a target cell and subsequently cause phagocytosis of the target cell is referred to as antibody dependent cell-mediated phagocytosis (ADCP).

The different IgG subclasses have different affinities for the FcγRs, with IgG1 and IgG3 typically binding substantially better to the receptors than IgG2 and IgG4. All FcγRs bind the same region on IgG Fc, yet with different affinities: the high affinity binder FcγRI has a Kd for IgG1 of 10-8 M-1, whereas the low affinity receptors FcγRII and FcγRIII generally bind at 10-6 and 10-5 respectively.

By "Fc gamma receptor" or "FcγR" as used herein is meant any member of the family of proteins that bind the IgG antibody Fc region and are substantially encoded by the FcγR genes. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIIb-NA1 and FcγRIIIb-NA2) (Jefferis et al., 2002, Immunol Lett 82:57-65), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

Binding to FcγRs can be performed directly by determining the affinity of an antibody for the FcγR. Or binding can be determined indirectly by measuring cytokine release in a cell-based assay.

To facilitate the association of a particular heavy chain with its cognate light chain, both the heavy and light chains may contain complimentary amino acid substitutions. As used herein, "complimentary amino acid substitutions" refer to a substitution to a positively-charged amino acid in one chain paired with a negatively-charged amino acid substitution in the other chain. For example, in some embodiments, the heavy chain comprises at least one amino acid substitution to introduce a charged amino acid and the corresponding light chain comprises at least one amino acid substitution to introduce a charged amino acid, wherein the charged amino acid introduced into the heavy chain has the opposite charge of the amino acid introduced into the light chain. In certain embodiments, one or more positively-charged residues (e.g., lysine, histidine or arginine) can be introduced into a first light chain (LC1) and one or more negatively-charged residues (e.g., aspartic acid or glutamic acid) can be introduced into the companion heavy chain (HC1) at the binding interface of LC1/HC1, whereas one or more negatively-charged residues (e.g., aspartic acid or glutamic acid) can be introduced into a second light chain (LC2) and one or more positively-charged residues (e.g., lysine, histidine or arginine) can be introduced into the companion heavy chain (HC2) at the binding interface of LC2/HC2. The electrostatic interactions will direct the LC1 to pair with HC1 and LC2 to pair with HC2, as the opposite charged residues (polarity) at the interface attract. The heavy/light chain pairs having the same charged residues (polarity) at an interface (e.g. LC1/HC2 and LC2/HC1) will repel, resulting in suppression of the unwanted HC/LC pairings.

In these and other embodiments, the CH1 domain of the heavy chain or the CL domain of the light chain comprises an amino acid sequence differing from wild-type IgG amino acid sequence such that one or more positively-charged amino acids in wild-type IgG amino acid sequence is replaced with one or more negatively-charged amino acids. Alternatively, the CH1 domain of the heavy chain or the CL domain of the light chain comprises an amino acid sequence differing from wild-type IgG amino acid sequence such that one or more negatively-charged amino acids in wild-type IgG amino acid sequence is replaced with one or more positively-charged amino acids. In some embodiments, one or more amino acids in the CH1 domain of the first and/or second heavy chain in the multispecific antibody construct at an EU position selected from F126, P127, L128, A141, L145, K147, D148, H168, F170, P171, V173, Q175, S176, S183, V185 and K213 is replaced with a charged amino acid. In certain embodiments, a heavy chain residue for substitution with a negatively- or positively-charged amino acid is S183 (EU numbering system). In some embodiments, S183 is substituted with a positively-charged amino acid. In alternative embodiments, S183 is substituted with a negatively-charged amino acid. For instance, in one embodiment, S183 is substituted with a negatively-charged amino acid (e.g. S183E) in the first heavy chain, and S183 is substituted with a positively-charged amino acid (e.g. S183K) in the second heavy chain.

In embodiments in which the light chain is a kappa light chain, one or more amino acids in the CL domain of the first and/or second light chain in the multimeric antibody construct at a position (EU numbering in a kappa light chain) selected from F116, F118, S121, D122, E123, Q124, S131, V133, L135, N137, N138, Q160, S162, T164, S174 and S176 is replaced with a charged amino acid. In embodiments in which the light chain is a lambda light chain, one or more amino acids in the CL domain of the first and/or second light chain in the multispecific antibody construct at a position (EU numbering in a lambda chain) selected from T116, F118, S121, E123, E124, K129, T131, V133, L135, S137, E160, T162, S165, Q167, A174, S176 and Y178 is replaced with a charged amino acid. In some embodiments, a residue for substitution with a negatively- or positively-charged amino acid is S176 (EU numbering system) of the CL domain of either a kappa or lambda light chain. In certain embodiments, S176 of the CL domain is replaced with a positively-charged amino acid. In alternative embodiments, S176 of the CL domain is replaced with a negatively-charged amino acid. In one embodiment, S176 is substituted with a positively-charged amino acid (e.g. S176K) in the first light chain, and S176 is substituted with a negatively-charged amino acid (e.g. S176E) in the second light chain.

In addition to or as an alternative to the complimentary amino acid substitutions in the CH1 and CL domains, the variable regions of the light and heavy chains in the multispecific antibody construct may contain one or more complimentary amino acid substitutions to introduce charged amino acids. For instance, in some embodiments, the VH region of the heavy chain or the VL region of the light chain of a multispecific antibody construct comprises an amino acid sequence differing from wild-type IgG amino acid sequence such that one or more positively-charged amino acids in wild-type IgG amino acid sequence is replaced with one or more negatively-charged amino acids. Alternatively, the VH region of the heavy chain or the VL region of the light chain comprises an amino acid sequence differing from wild-type IgG amino acid sequence such that one or more negatively-charged amino acids in wild-type IgG amino acid sequence is replaced with one or more positively-charged amino acids.

V region interface residues (i.e., amino acid residues that mediate assembly of the VH and VL regions) within the VH region include EU positions 1, 3, 35, 37, 39, 43, 44, 45, 46, 47, 50, 59, 89, 91, and 93. One or more of these interface residues in the VH region can be substituted with a charged (positively- or negatively-charged) amino acid. In certain embodiments, the amino acid at EU position 39 in the VH region of the first and/or second heavy chain is substituted for a positively-charged amino acid, e.g., lysine. In alternative embodiments, the amino acid at EU position 39 in the VH region of the first and/or second heavy chain is substituted for a negatively-charged amino acid, e.g., glutamic acid. In some embodiments, the amino acid at EU position 39 in the VH region of the first heavy chain is substituted for a negatively-charged amino acid (e.g. G39E), and the amino acid at EU position 39 in the VH region of the second heavy chain is substituted for a positively-charged amino acid (e.g. G39K). In some embodiments, the amino acid at EU position 44 in the VH region of the first and/or second heavy chain is substituted for a positively-charged amino acid, e.g., lysine. In alternative embodiments, the amino acid at EU position 44 in the VH region of the first and/or second heavy chain is substituted for a negatively-charged amino acid, e.g., glutamic acid. In certain embodiments, the amino acid at EU position 44 in the VH region of the first heavy chain is substituted for a negatively-charged amino acid (e.g. G44E), and the amino acid at EU position 44 in the VH region of the second heavy chain is substituted for a positively-charged amino acid (e.g. G44K).

V region interface residues (i.e., amino acid residues that mediate assembly of the VH and VL regions) within the VL region include EU positions 32, 34, 35, 36, 38, 41, 42, 43, 44, 45, 46, 48, 49, 50, 51, 53, 54, 55, 56, 57, 58, 85, 87, 89, 90, 91, and 100. One or more interface residues in the VL region can be substituted with a charged amino acid, preferably an amino acid that has an opposite charge to those introduced into the VH region of the cognate heavy chain. In some embodiments, the amino acid at EU position 100 in the VL region of the first and/or second light chain is substituted for a positively-charged amino acid, e.g., lysine. In alternative embodiments, the amino acid at EU position 100 in the VL region of the first and/or second light chain is substituted for a negative-charged amino acid, e.g., glutamic acid. In certain embodiments, the amino acid at EU position 100 in the VL region of the first light chain is substituted for a positively-charged amino acid (e.g. G100K), and the amino acid at EU position 100 in the VL region of the second light chain is substituted for a negatively-charged amino acid (e.g. G100E).

Any of the constant domains can be modified to contain one or more of the charge pair mutations described above to facilitate correct assembly of a multispecific antibody construct.

As used herein, the term "Fc region" refers to the C-terminal region of an immunoglobulin heavy chain which may be generated by papain digestion of an intact antibody. The Fc region of an immunoglobulin generally comprises two constant domains, a CH2 domain and a CH3 domain, and optionally comprises a CH4 domain. In certain embodiments, the Fc region is an Fc region from an IgG1, IgG2, IgG3, or IgG4 immunoglobulin. In some embodiments, the Fc region comprises CH2 and CH3 domains from a human IgG1 or human IgG2 immunoglobulin. The Fc region may retain effector function, such as C1q binding, complement dependent cytotoxicity (CDC), Fc receptor binding, antibody-dependent cell-mediated cytotoxicity (ADCC), and phagocytosis. In other embodiments, the Fc region may be modified to reduce or eliminate effector function as described in further detail herein.

The heavy chain constant regions or the Fc regions of the multispecific antibody constructs described herein may comprise one or more amino acid substitutions that affect the glycosylation and/or effector function of the antigen binding protein. One of the functions of the Fc region of an immunoglobulin is to communicate to the immune system when the immunoglobulin binds its target. This is commonly referred to as "effector function." Communication leads to antibody-dependent cellular cytotoxicity (ADCC), antibody-dependent cellular phagocytosis (ADCP), and/or complement dependent cytotoxicity (CDC). ADCC and ADCP are mediated through the binding of the Fc region to Fc receptors on the surface of cells of the immune system. CDC is mediated through the binding of the Fc with proteins of the complement system, e.g., C1q. In some embodiments, the multispecific antibody constructs of the invention comprise one or more amino acid substitutions in the constant region to enhance effector function, including ADCC activity, CDC activity, ADCP activity, and/or the clearance or half-life of the antigen binding protein. Exemplary amino acid substitutions (EU numbering) that can enhance effector function include, but are not limited to, E233L, L234I, L234Y, L235S, G236A, S239D, F243L, F243V, P247I, D280H, K290S, K290E, K290N, K290Y, R292P, E294L, Y296W, S298A, S298D, S298V, S298G, S298T, T299A, Y300L, V305I, Q311M, K326A, K326E, K326W, A330S, A330L, A330M, A330F, I332E, D333A, E333S, E333A, K334A, K334V, A339D, A339Q, P396L, or combinations of any of the foregoing.

In other embodiments, the multispecific antibody constructs of the invention comprise one or more amino acid substitutions in the constant region to reduce effector function. Exemplary amino acid substitutions (EU numbering) that can reduce effector function include, but are not limited to, C220S, C226S, C229S, E233P, L234A, L234V, V234A, L234F, L235A, L235E, G237A, P238S, S267E, H268Q, N297A, N297G, V309L, E318A, L328F, A330S, A331S, P331S or combinations of any of the foregoing.

Glycosylation can contribute to the effector function of antibodies, particularly IgG1 antibodies. Thus, in some embodiments, the multispecific antibody constructs of the invention may comprise one or more amino acid substitutions that affect the level or type of glycosylation of the binding proteins. Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

In certain embodiments, glycosylation of the multispecific antibody constructs described herein is increased by adding one or more glycosylation sites, e.g., to the Fc region of the binding protein. Addition of glycosylation sites to the antigen binding protein can be conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the antigen binding protein amino acid sequence may be altered through changes at the DNA level, particularly by mutating the DNA encoding the target polypeptide at preselected bases such that codons are generated that will translate into the desired amino acids.

The invention also encompasses production of multispecific antibody construct molecules with altered carbohydrate structure resulting in altered effector activity, including antigen binding proteins with absent or reduced fucosylation that exhibit improved ADCC activity. Various methods are known in the art to reduce or eliminate fucosylation. For example, ADCC effector activity is mediated by binding of the antibody molecule to the FcγRIII receptor, which has been shown to be dependent on the carbohydrate structure of the N-linked glycosylation at the N297 residue of the CH2 domain. Non-fucosylated antibodies bind this receptor with increased affinity and trigger FcγRIII-mediated effector functions more efficiently than native, fucosylated antibodies. For example, recombinant production of non-fucosylated antibody in CHO cells in which the alpha-1,6-fucosyl transferase enzyme has been knocked out results in antibody with 100-fold increased ADCC activity (see Yamane-Ohnuki et al., Biotechnol Bioeng. 87(5):614-22, 2004). Similar effects can be accomplished through decreasing the activity of alpha-1,6-fucosyl transferase enzyme or other enzymes in the fucosylation pathway, e.g., through siRNA or antisense RNA treatment, engineering cell lines to knockout the enzyme(s), or culturing with selective glycosylation inhibitors (see Rothman et al., Mol Immunol. 26(12):1113-23, 1989). Some host cell strains, e.g. Lec13 or rat hybridoma YB2/0 cell line naturally produce antibodies with lower fucosylation levels (see Shields et al., J Biol Chem. 277(30):26733-40, 2002 and Shinkawa et al., J Biol Chem. 278(5):3466-73, 2003). An increase in the level of bisected carbohydrate, e.g. through recombinantly producing antibody in cells that overexpress GnTIII enzyme, has also been determined to increase ADCC activity (see Umana et al., Nat Biotechnol. 17(2):176-80, 1999).

In other embodiments, glycosylation of the multispecific antibody constructs described herein is decreased or eliminated by removing one or more glycosylation sites, e.g., from the Fc region of the binding protein. Amino acid substitutions that eliminate or alter N-linked glycosylation sites can reduce or eliminate N-linked glycosylation of the antigen binding protein. In certain embodiments, the multispecific antibody constructs described herein comprise a mutation at position N297 (EU numbering), such as N297Q, N297A, or N297G. In certain embodiments, the multispecific antibody constructs described herein comprise a mutation at positions L234 and L235 (EU numbering), such as L234A and L235A. In one particular embodiment, the multispecific antibody constructs of the invention comprise a Fc region from a human IgG1 antibody with a N297G mutation. To improve the stability of molecules comprising a N297 mutation, the Fc region of the molecules may be further engineered. For instance, in some embodiments, one or more amino acids in the Fc region are substituted with cysteine to promote disulfide bond formation in the dimeric state. Residues corresponding to V259, A287, R292, V302, L306, V323, or I332 (EU numbering) of an IgG1 Fc region may thus be substituted with cysteine. In one embodiment, specific pairs of residues are substituted with cysteine such that they preferentially form a disulfide bond with each other, thus limiting or preventing disulfide bond scrambling. In certain embodiments pairs include, but are not limited to, A287C and L306C, V259C and L306C, R292C and V302C, and V323C and I332C. In particular embodiments, the multispecific antibody constructs described herein comprise a Fc region from a human IgG1 antibody with mutations at R292C and V302C. In such embodiments, the Fc region may also comprise a N297G mutation.

In one embodiment, the heavy chain comprises an amino acid substitution selected from the group consisting of:
(i) N297G or N297A;
(ii) L234A and L235A; and
(iii) R292C and V302C;
wherein the amino acid numbering is EU numbering according to Kabat.

In one embodiment, the heavy chain comprises N297G, R292C, and V302C mutations, wherein the amino acid numbering is EU numbering according to Kabat.

Modifications of the multispecific antibody constructs of the invention to increase serum half-life also may desirable, for example, by incorporation of or addition of a salvage receptor binding epitope (e.g., by mutation of the appropriate region or by incorporating the epitope into a peptide tag that is then fused to the antigen binding protein at either end or in the middle, e.g., by DNA or peptide synthesis; see, e.g., WO96/32478) or adding molecules such as PEG or other water soluble polymers, including polysaccharide polymers. The salvage receptor binding epitope preferably constitutes a region wherein any one or more amino acid residues from one or two loops of a Fc region are transferred to an analogous position in the antigen binding protein. In one embodiment, three or more residues from one or two loops of the Fc region are transferred. In one embodiment, the epitope is taken from the CH2 domain of the Fc region (e.g., an IgG Fc region) and transferred to the CH1, CH3, or VH region, or more than one such region, of the antigen binding protein. Alternatively, the epitope is taken from the CH2 domain of the Fc region and transferred to the CL region or VL region, or both, of the antigen binding protein. See International applications WO 97/34631 and WO 96/32478 for a description of Fc variants and their interaction with the salvage receptor.

In certain embodiments of the multispecific antibody construct of the invention, the binding domain positioned at the amino terminus of the Fc region (i.e. the amino-terminal binding domain) is a Fab fragment fused to the amino terminus of the Fc region through a peptide linker described herein or through an immunoglobulin hinge region. An "immunoglobulin hinge region" refers to the amino acid sequence connecting the CH1 domain and the CH2 domain of an immunoglobulin heavy chain. The hinge region of human IgG1 is generally defined as the amino acid sequence from about Glu216 or about Cys226, to about Pro230. Hinge regions of other IgG isotypes may be aligned with the IgG1 sequence by placing the first and last cysteine residues forming inter-heavy chain disulfide bonds in the same positions and are determinable to those of skill in the art. In some embodiments, the amino-terminal binding domain is joined to the amino terminus of the Fc region through a human IgG1 hinge region. In other embodiments, the amino-terminal binding domain is joined to the amino terminus of the Fc region through a human IgG2 hinge region. In one embodiment, the amino-terminal binding domain (e.g. Fab fragment) is fused to the Fc region through the carboxyl terminus of the CH1 region of the Fab.

In some embodiments of the heavy chain fusion proteins of the invention, the binding domain positioned at the carboxyl terminus of the Fc region (i.e. the carboxyl-terminal binding domain) is a Fab fragment. In such embodiments, the Fab is fused or otherwise connected to the carboxyl terminus of the Fc region (e.g. the carboxyl terminus of the CH3 domain) through a peptide linker through the amino terminus of the VH region of the Fab fragment.

Thus, in one embodiment, the Fab is fused to an Fc region through the amino terminus of the VH region of the Fab such that the resulting fusion protein comprises, from N-terminus to C-terminus, a CH2 domain, a CH3 domain, a peptide linker, a VH region, and a CH1 region.

The peptide linker joining the Fc region to the carboxyl-terminal Fab can be any of the peptide linkers described herein. In particular embodiments, the peptide linker joining the Fc region to the carboxyl-terminal Fab fragment is at least 5 amino acids in length. In other embodiments, the peptide linker joining the Fc region to the carboxyl-terminal Fab fragment is at least 8 amino acids in length. Particularly suitable peptide linkers for joining the Fc region to the carboxyl-terminal Fab fragment are glycine-serine linkers, such as $(Gly_xSer)_n$ where x=3 or 4 and n=2, 3, 4, 5 or 6 (SEQ ID NO: 923). In one embodiment, the peptide linker connecting the Fc region to the carboxyl-terminal Fab fragment is a L10 $(G_4S)_2$ linker (SEQ ID NO: 888). In another embodiment, the peptide linker connecting the Fc region to the carboxyl-terminal Fab fragment is a L9 or $G_3SG_4S$ linker (SEQ ID NO: 924).

In some embodiments of the antigen binding proteins of the invention in which the carboxyl-terminal binding domain is a Fab fragment, the binding domain positioned at the amino terminus of the Fc region (i.e. the amino-terminal binding domain) is also a Fab fragment. The amino-terminal Fab fragment can be fused to the amino terminus of the Fc region through a peptide linker or an immunoglobulin hinge region described herein. In some embodiments, the amino-terminal Fab fragment is joined to the amino terminus of the Fc region through a human IgG1 hinge region. In other embodiments, the amino-terminal Fab fragment is joined to the amino terminus of the Fc region through a human IgG2 hinge region. In one embodiment, the amino-terminal Fab fragment is fused to the Fc region through the carboxyl terminus of the CH1 region of the Fab.

In some embodiments, the multispecific antibody construct of the invention comprises a first antibody that specifically binds to a first target where one polypeptide chain (e.g. the heavy chain (VH2-CH1)) of a Fab fragment from a second antibody that specifically binds to a second target is fused to the carboxyl terminus of the heavy chain of the first antibody. The multispecific antibody construct in such embodiments also comprises a polypeptide chain containing the other half of the Fab fragment from the second antibody (e.g., the light chain (VL2-CL)). This format is referred to herein as the "IgG-Fab" format, and one embodiment of this type of molecule is shown schematically in FIG. 1. Thus, in certain embodiments, the present invention includes a bispecific, multivalent antigen binding protein comprising: (i) a light chain from a first antibody, (ii) a heavy chain from the first antibody, wherein the heavy chain is fused at its carboxyl terminus through a peptide linker to a first polypeptide comprising VH-CH1 domains of a second antibody to form a modified heavy chain, and (iii) a second polypeptide comprising VL-CL domains of the second antibody. When dimerized, the multispecific antibody construct is a homohexamer comprising two modified heavy chains, two light chains from the first antibody, and two polypeptide chains containing the other half of the Fab fragment from the second antibody (the Fd fragment). In one embodiment, the first polypeptide, which is fused to the carboxyl terminus of the heavy chain, comprises VH and CH1 domains from the second antibody, and the second polypeptide comprises VL and CL domains from the second antibody.

Charge pair mutations or complimentary amino acid substitutions as described herein can be introduced into the Fab regions of the first antibody (Fab 1) or second antibody (Fab 2) to promote correct heavy chain-light chain pairing. For instance, in some embodiments, the amino acid at EU position 38 of the VL domain in Fab 1 is replaced with a negatively-charged amino acid (e.g. glutamic acid) and the amino acid at EU position 39 of the VH domain in Fab 1 is replaced with a positively-charged amino acid (e.g. lysine). In other embodiments, the amino acid at EU position 38 of the VL domain in Fab 1 is replaced with a positively-charged amino acid (e.g. lysine) and the amino acid at EU position 39 of the VH domain in Fab 1 is replaced with a negatively-charged amino acid (e.g. glutamic acid). In certain embodiments, the amino acid at EU position 38 of the VL domain in Fab 2 is replaced with a negatively-charged amino acid (e.g. glutamic acid) and the amino acid at EU position 39 of the VH domain in Fab 2 is replaced with a positively-charged amino acid (e.g. lysine). In other embodiments, the amino acid at EU position 38 of the VL domain in Fab 2 is replaced with a positively-charged amino acid (e.g. lysine) and the amino acid at EU position 39 of the VH domain in Fab 2 is replaced with a negatively-charged amino acid (e.g. glutamic acid).

In embodiments in which the VH-CH1 region (i.e. Fd fragment) from the second antibody is fused to the heavy chain of the first antibody, the heavy chain from the first antibody comprises a S183E mutation (EU numbering), the light chain from the first antibody comprises a S176K mutation (EU numbering), the light chain from the second antibody comprises a S176E mutation (EU numbering), and the Fd region from the second antibody (which is fused to the C-terminus of the heavy chain from the first antibody) comprises a S183K mutation (EU numbering). In other embodiments, the heavy chain from the first antibody comprises a G44E mutation (EU) and S183E mutation (EU numbering), the light chain from the first antibody comprises a G100K mutation (EU) and S176K mutation (EU numbering), the light chain from the second antibody comprises a G100E mutation (EU) and S176E mutation (EU numbering), and the Fd region from the second antibody (which is fused to the C-terminus of the heavy chain from the first antibody) comprises a G44K mutation (EU) and S183K mutation (EU numbering). The charges in the foregoing examples may be reversed so long as the charge on the corresponding light or heavy chain is also reversed so that the correct heavy/light chain pairs have opposite charges.

"Corresponds to" as it pertains to the VH2 and second CH1 domain means that the amino acid residues of the VH2 and second CH1 domain are counted from the C-terminus of the first heavy chain if there is no linker. If there is a peptide linker, the amino acid residues of the VH2 and second CH1 domain are counted from the C-terminus of the peptide linker. In neither case are the amino acid residues counted from the N-terminus of the first heavy chain. Rather, for the VH2 and second CH1 domain, counting begins at the first amino acid residue of the VH2 domain. The counting of amino acid residues is performed using the EU or AHo convention.

In certain embodiments: a) the VH1 comprises a Q39E mutation and the first CH1 domain comprises a S183K mutation using EU numbering; b) the VH2 comprises a Q39K mutation and the second CH1 domain comprises a S183E mutation using EU numbering; c) the VL1 comprises a Q38K mutation and the first CL domain comprises a S176E mutation using EU numbering; and d) the VL2 comprises a Q38E mutation and the second CL domain comprises a S176K mutation using EU numbering.

In certain embodiments: a) the first CH1 domain comprises G44E and S183K mutations using EU numbering; b) the second CH1 domain comprises G44K and S183E mutations using EU numbering; c) the first CL domain comprises G100K and S176E mutations using EU numbering; and d) the second CL domain comprises G100E and S176K mutations using EU numbering.

In certain embodiments: a) the VH1 comprises a Q39K mutation and the first CH1 domain comprises a S183E mutation using EU numbering; b) the VH2 comprises a Q39E mutation and the second CH1 domain comprises a S183K mutation using EU numbering; c) the VL1 comprises a Q38E mutation and the first CL domain comprises a S176K mutation using EU numbering; and d) the VL2 comprises a Q38K mutation and the second CL domain comprises a S176E mutation using EU numbering.

In certain embodiments: a) the first CH1 domain comprises G44K and S183E mutations using EU numbering; b) the second CH1 domain comprises G44E and S183K mutations using EU numbering; c) the first CL domain comprises G100E and S176K mutations using EU numbering; and d) the second CL domain comprises G100K and S176E mutations using EU numbering.

In certain embodiments the first heavy chain is fused to the VH2 via a peptide linker. In certain embodiments the peptide linker comprises a sequence selected from the group consisting of (Gly$_3$Ser)$_2$ (SEQ ID NO: 916), (Gly$_4$Ser)$_2$ (SEQ ID NO: 888), (Gly$_3$Ser)$_3$ (SEQ ID NO: 917), (Gly$_4$Ser)$_3$ (SEQ ID NO: 889), (Gly$_3$Ser)$_4$ (SEQ ID NO: 918), (Gly$_4$Ser)$_4$ (SEQ ID NO: 890), (Gly$_3$Ser)$_5$ (SEQ ID NO: 919), (Gly$_4$Ser)$_5$ (SEQ ID NO: 920), (Gly$_3$Ser)$_6$ (SEQ ID NO: 921), and (Gly$_4$Ser)$_6$ (SEQ ID NO: 922). These sequences can also be written as GGGSGGGS (SEQ ID NO: 916), GGGGSGGGGS (SEQ ID NO: 888), GGGSGGGSGGGS (SEQ ID NO: 917), GGGGSGGGGSGGGGS (SEQ ID NO: 889), GGGSGGGSGGGSGGGS (SEQ ID NO: 918), GGGGSGGGGSGGGGSGGGGS (SEQ ID NO: 890), GGGSGGGSGGGSGGGSGGGS (SEQ ID NO: 919), GGGGSGGGGSGGGGSGGGGSGGGGS (SEQ ID NO: 920), GGGSGGGSGGGSGGGSGGGSGGGS (SEQ ID NO: 921), and GGGGSGGGGSGGGGSGGGGSGGGGSGGGGS (SEQ ID NO: 922).

Additionally or alternatively, correct heavy-light chain pairing may be facilitated by swapping the CH1 and CL domains in the carboxyl-terminal Fab binding domain. By way of example, the first polypeptide, which is fused to the carboxyl terminus of the heavy chain, may comprise a VL domain and CH1 domain from the second antibody, and the second polypeptide may comprise a VH domain and CL domain from the second antibody. In another embodiment, the first polypeptide, which is fused to the carboxyl terminus of the heavy chain, may comprise a VH domain and a CL domain from the second antibody, and the second polypeptide may comprise a VL domain and CH1 domain from the second antibody.

In another aspect, the present invention is directed to a multispecific antibody construct comprising:
 a) two identical heavy chain fusion proteins each comprising a first heavy chain variable region (VH1) and a first CH1 domain, wherein the first CH1 domain is linked to a hinge-CH2-CH3 polypeptide, and wherein the hinge-CH2-CH3 polypeptide is linked to a second heavy chain variable region (VH2), wherein the VH2 is linked to a second CH1 domain; wherein
 i) the VH1 or first CH1 domain comprises at least one amino acid substitution to introduce a positively charged amino acid at a residue selected from the group consisting of positions 39, 44, and 183 using EU numbering; and
 ii) the VH2 or second CH1 domain comprises at least one amino acid substitution to introduce a negatively charged amino acid at a residue selected from the group consisting of a residue that corresponds to positions 39, 44, and 183 using EU numbering; and
 b) a second polypeptide comprising a first light chain, wherein the first light chain comprises a first light chain variable region (VL1) and a first CL region; and wherein the VL1 or first CL domain comprises at least one amino acid substitution to introduce a negatively charged amino acid at a residue selected from the group consisting of positions 38, 100, and 176 using EU numbering; and
 c) a third polypeptide comprising a second light chain, wherein the second light chain comprises a second light chain variable region (VL2) and a second CL region; and wherein the VL2 or second CL domain comprises at least one amino acid substitution to introduce a positively charged amino acid at a residue selected from the group consisting of positions 38, 100, and 176 using EU numbering;
 wherein the VH1 and VL1 interact to bind a first antigen and wherein the VH2 and VL2 interact to bind a second antigen;
 wherein:
 the first antigen is human CD40 (SEQ ID NO: 1) and the second antigen is human mesothelin ("MSLN"; SEQ ID NO: 2); or
 the first antigen is human MSLN (SEQ ID NO: 2) and the second antigen is human CD40 (SEQ ID NO: 1).

In one aspect, the present invention is directed to a multispecific antibody construct comprising:
 a) two identical heavy chain fusion proteins each comprising a first heavy chain variable region (VH1) and a first CH1 domain, wherein the first CH1 domain is linked to a hinge-CH2-CH3 polypeptide, and wherein the hinge-CH2-CH3 polypeptide is linked to a second heavy chain variable region (VH2), wherein the VH2 is linked to a second CH1 domain; wherein
 i) the VH1 or first CH1 domain comprises at least one amino acid substitution to introduce a negatively charged amino acid at a residue selected from the group consisting of positions 39, 44, and 183 using EU numbering; and
 ii) the VH2 or second CH1 domain comprises at least one amino acid substitution to introduce a positively charged amino acid at a residue selected from the group consisting of a residue that corresponds to positions 39, 44, and 183 using EU numbering; and
 b) a second polypeptide comprising a first light chain, wherein the first light chain comprises a first light chain variable region (VL1) and a first CL region; and wherein the VL1 or first CL domain comprises at least one amino acid substitution to introduce a positively charged amino acid at a residue selected from the group consisting of positions 38, 100, and 176 using EU numbering; and
 c) a third polypeptide comprising a second light chain, wherein the second light chain comprises a second light chain variable region (VL2) and a second CL region; and wherein the VL2 or second CL domain comprises at least one amino acid substitution to introduce a negatively charged amino acid at a residue selected from the group consisting of positions 38, 100, and 176 using EU numbering;

wherein the VH1 and VL1 interact to bind a first antigen and wherein the VH2 and VL2 interact to bind a second antigen;

wherein:

the first antigen is human CD40 (SEQ ID NO: 1) and the second antigen is human mesothelin ("MSLN"; SEQ ID NO: 2); or the first antigen is human MSLN (SEQ ID NO: 2) and the second antigen is human CD40 (SEQ ID NO: 1).

In one embodiment, the hinge-CH2-CH3 polypeptide is linked to the VH2 via a peptide linker.

In one embodiment, the peptide linker comprises a sequence selected from the group consisting of (Gly$_3$Ser)$_2$ (SEQ ID NO: 916), (Gly$_4$Ser)$_2$ (SEQ ID NO: 888), (Gly$_3$Ser)$_3$ (SEQ ID NO: 917), (Gly$_4$Ser)$_3$ (SEQ ID NO: 889), (Gly$_3$Ser)$_4$ (SEQ ID NO: 918), (Gly$_4$Ser)$_4$ (SEQ ID NO: 890), (Gly$_3$Ser)$_5$ (SEQ ID NO: 919), (Gly$_4$Ser)$_5$ (SEQ ID NO: 920), (Gly$_3$Ser)$_6$ (SEQ ID NO: 921), and (Gly$_4$Ser)$_6$ (SEQ ID NO: 922).

In one embodiment,
a) the VH1 or first CH1 domain comprises a mutation selected from the group consisting of Q39K, G44K, and S183K using EU numbering;
b) the VH2 or second CH1 domain comprises a mutation selected from the group consisting of Q39E, G44E, and S183E using EU numbering;
c) the VL1 or first CL domain comprises a mutation selected from the group consisting of Q38E, G100E, and S176E using EU numbering; and
d) the VL2 or second CL domain comprises a mutation selected from the group consisting of Q38K, G100K, and S176K using EU numbering.

In one embodiment,
a) the first CH1 domain comprises a S183K mutation using EU numbering;
b) the second CH1 domain comprises a S183E mutation using EU numbering;
c) the first CL domain comprises a S176E mutation using EU numbering; and
d) the second CL domain comprises a S176K mutation using EU numbering.

In one embodiment,
a) the VH1 comprises a Q39K mutation and the first CH1 domain comprises a S183K mutation using EU numbering;
b) the VH2 comprises a Q39E mutation and the second CH1 domain comprises a S183E mutation using EU numbering;
c) the VL1 comprises a Q38E mutation and the first CL domain comprises a S176E mutation using EU numbering; and
d) the VL2 comprises a Q38K mutation and the second CL domain comprises a S176K mutation using EU numbering.

In one embodiment,
a) the first CH1 domain comprises G44K and S183K mutations using EU numbering;
b) the second CH1 domain comprises G44E and S183E mutations using EU numbering;
c) the first CL domain comprises G100E and S176E mutations using EU numbering; and
d) the second CL domain comprises G100K and S176K mutations using EU numbering.

In one embodiment,
a) the VH1 or first CH1 domain comprises a mutation selected from the group consisting of Q39E, G44E, and S183E using EU numbering;
b) the VH2 or second CH1 domain comprises a mutation selected from the group consisting of Q39K, G44K, and S183K using EU numbering;
c) the VL1 or first CL domain comprises a mutation selected from the group consisting of Q38K, G100K, and S176K using EU numbering; and
d) the VL2 or second CL domain comprises a mutation selected from the group consisting of Q38E, G100E, and S176E using EU numbering.

In one embodiment,
a) the first CH1 domain comprises a S183E mutation using EU numbering;
b) the second CH1 domain comprises a S183K mutation using EU numbering;
c) the first CL domain comprises a S176K mutation using EU numbering; and
d) the second CL domain comprises a S176E mutation using EU numbering.

In one embodiment,
a) the VH1 comprises a Q39E mutation and the first CH1 domain comprises a S183E mutation using EU numbering;
b) the VH2 comprises a Q39K mutation and the second CH1 domain comprises a S183K mutation using EU numbering;
c) the VL1 comprises a Q38K mutation and the first CL domain comprises a S176K mutation using EU numbering; and
d) the VL2 comprises a Q38E mutation and the second CL domain comprises a S176E mutation using EU numbering.

In one embodiment,
a) the first CH1 domain comprises G44E and S183E mutations using EU numbering;
b) the second CH1 domain comprises G44K and S183K mutations using EU numbering;
c) the first CL domain comprises G100K and S176K mutations using EU numbering; and
d) the second CL domain comprises G100E and S176E mutations using EU numbering.

In one embodiment, the hinge-CH2-CH3 polypeptide comprises an amino acid substitution selected from the group consisting of:
(i) N297G or N297A;
(ii) L234A and L235A; and
(iii) R292C and V302C;
wherein the amino acid numbering is EU numbering according to Kabat.

In one embodiment, the hinge-CH2-CH3 polypeptide comprises N297G, R292C, and V302C mutations, wherein the amino acid numbering is EU numbering according to Kabat.

In one embodiment, the first antigen is human CD40 (SEQ ID NO: 1) and the second antigen is human MSLN (SEQ ID NO: 2); and the VL1 comprises a CDRL1, a CDRL2, and a CDRL3 selected from the group consisting of:
SEQ ID NOs: 58, 59, and 60, respectively;
SEQ ID NOs: 64, 65, and 66, respectively;
SEQ ID NOs: 70, 71, and 72, respectively;
SEQ ID NOs: 76, 77, and 78, respectively;
SEQ ID NOs: 82, 83, and 84, respectively;
SEQ ID NOs: 88, 89, and 90, respectively;
SEQ ID NOs: 94, 95, and 96, respectively;

SEQ ID NOs: 100, 101, and 102, respectively;
SEQ ID NOs: 106, 107, and 108, respectively;
SEQ ID NOs: 112, 113, and 114, respectively;
SEQ ID NOs: 118, 119, and 120, respectively;
SEQ ID NOs: 124, 125, and 126, respectively; and
SEQ ID NOs: 130, 131, and 132, respectively;
the VH1 comprises a CDRH1, a CDRH2, and a CDRH3 selected from the group consisting of:
SEQ ID NOs: 136, 137, and 138, respectively;
SEQ ID NOs: 142, 143, and 144, respectively;
SEQ ID NOs: 148, 149, and 150, respectively;
SEQ ID NOs: 154, 155, and 156, respectively;
SEQ ID NOs: 160, 161, and 162, respectively;
SEQ ID NOs: 166, 167, and 168, respectively;
SEQ ID NOs: 172, 173, and 174, respectively;
SEQ ID NOs: 178, 179, and 180, respectively;
SEQ ID NOs: 184, 185, and 186, respectively;
SEQ ID NOs: 190, 191, and 192, respectively;
SEQ ID NOs: 196, 197, and 198, respectively;
SEQ ID NOs: 202, 203, and 204, respectively; and
SEQ ID NOs: 208, 209, and 210, respectively;
the VL2 comprises a CDRL1, a CDRL2, and a CDRL3 selected from the group consisting of:
SEQ ID NOs: 230, 231, and 232, respectively;
SEQ ID NOs: 236, 237, and 238, respectively;
SEQ ID NOs: 242, 243, and 244, respectively; and
SEQ ID NOs: 248, 249, and 250, respectively;
and the VH2 comprises a CDRH1, a CDRH2, and a CDRH3 selected from the group consisting of:
SEQ ID NOs: 254, 255, and 256, respectively;
SEQ ID NOs: 260, 261, and 262, respectively;
SEQ ID NOs: 266, 267, and 268, respectively; and
SEQ ID NOs: 272, 273, and 274, respectively.

64. The antibody construct of claim 63, wherein
1) the VL1 and VH1 are selected from the group consisting of:
   a) a VL1 comprising a CDRL1, a CDRL2, and a CDRL3 selected from the group consisting of SEQ ID NOs: 58, 59, and 60, respectively; and a VH1 comprising a CDRH1, a CDRH2, and a CDRH3 selected from the group consisting of SEQ ID NOs: 136, 137, and 138, respectively;
   b) a VL1 comprising a CDRL1, a CDRL2, and a CDRL3 selected from the group consisting of SEQ ID NOs: 64, 65, and 66, respectively; and a VH1 comprising a CDRH1, a CDRH2, and a CDRH3 selected from the group consisting of SEQ ID NOs: 142, 143, and 144, respectively;
   c) a VL1 comprising a CDRL1, a CDRL2, and a CDRL3 selected from the group consisting of SEQ ID NOs: 70, 71, and 72, respectively; and a VH1 comprising a CDRH1, a CDRH2, and a CDRH3 selected from the group consisting of SEQ ID NOs: 148, 149, and 150, respectively;
   d) a VL1 comprising a CDRL1, a CDRL2, and a CDRL3 selected from the group consisting of SEQ ID NOs: 76, 77, and 6780, respectively; and a VH1 comprising a CDRH1, a CDRH2, and a CDRH3 selected from the group consisting of SEQ ID NOs: 154, 155, and 156, respectively;
   e) a VL1 comprising a CDRL1, a CDRL2, and a CDRL3 selected from the group consisting of SEQ ID NOs: 82, 83, and 84, respectively; and a VH1 comprising a CDRH1, a CDRH2, and a CDRH3 selected from the group consisting of SEQ ID NOs: 160, 161, and 162, respectively;
   f) a VL1 comprising a CDRL1, a CDRL2, and a CDRL3 selected from the group consisting of SEQ ID NOs: 88, 89, and 90, respectively; and a VH1 comprising a CDRH1, a CDRH2, and a CDRH3 selected from the group consisting of SEQ ID NOs: 166, 167, and 168, respectively;
   g) a VL1 comprising a CDRL1, a CDRL2, and a CDRL3 selected from the group consisting of SEQ ID NOs: 94, 95, and 96, respectively; and a VH1 comprising a CDRH1, a CDRH2, and a CDRH3 selected from the group consisting of SEQ ID NOs: 172, 173, and 174, respectively;
   h) a VL1 comprising a CDRL1, a CDRL2, and a CDRL3 selected from the group consisting of SEQ ID NOs: 100, 101, and 102, respectively; and a VH1 comprising a CDRH1, a CDRH2, and a CDRH3 selected from the group consisting of SEQ ID NOs: 178, 179, and 180, respectively;
   i) a VL1 comprising a CDRL1, a CDRL2, and a CDRL3 selected from the group consisting of SEQ ID NOs: 106, 107, and 108, respectively; and a VH1 comprising a CDRH1, a CDRH2, and a CDRH3 selected from the group consisting of SEQ ID NOs: 184, 185, and 186, respectively;
   j) a VL1 comprising a CDRL1, a CDRL2, and a CDRL3 selected from the group consisting of SEQ ID NOs: 112, 113, and 114, respectively; and a VH1 comprising a CDRH1, a CDRH2, and a CDRH3 selected from the group consisting of SEQ ID NOs: 190, 191, and 192, respectively;
   k) a VL1 comprising a CDRL1, a CDRL2, and a CDRL3 selected from the group consisting of SEQ ID NOs: 118, 119, and 120, respectively; and a VH1 comprising a CDRH1, a CDRH2, and a CDRH3 selected from the group consisting of SEQ ID NOs: 196, 197, and 198, respectively;
   l) a VL1 comprising a CDRL1, a CDRL2, and a CDRL3 selected from the group consisting of SEQ ID NOs: 124, 125, and 126, respectively; and a VH1 comprising a CDRH1, a CDRH2, and a CDRH3 selected from the group consisting of SEQ ID NOs: 202, 203, and 204, respectively; and
   m) a VL1 comprising a CDRL1, a CDRL2, and a CDRL3 selected from the group consisting of SEQ ID NOs: 130, 131, and 132, respectively; and a VH1 comprising a CDRH1, a CDRH2, and a CDRH3 selected from the group consisting of SEQ ID NOs: 208, 209, and 210, respectively;
and
2) the VL2 and VH2 are selected from the group consisting of:
   a) a VL2 comprising a CDRL1, a CDRL2, and a CDRL3 selected from the group consisting of SEQ ID NOs: 230, 231, and 232, respectively; and a VH2 comprising a CDRH1, a CDRH2, and a CDRH3 selected from the group consisting of SEQ ID NOs: 254, 255, and 256, respectively;
   b) a VL2 comprising a CDRL1, a CDRL2, and a CDRL3 selected from the group consisting of SEQ ID NOs: 236, 237, and 238, respectively; and a VH2 comprising a CDRH1, a CDRH2, and a CDRH3 selected from the group consisting of SEQ ID NOs: 260, 261, and 262, respectively;
   c) a VL2 comprising a CDRL1, a CDRL2, and a CDRL3 selected from the group consisting of SEQ ID NOs: 242, 243, and 244, respectively; and a VH2 comprising a CDRH1, a CDRH2, and a CDRH3 selected from the group consisting of SEQ ID NOs: 266, 267, and 268, respectively; and d) a VL2 comprising a CDRL1, a CDRL2, and a CDRL3 selected from the group consisting of SEQ ID NOs: 248, 249, and 250, respectively; and a VH2 comprising a CDRH1, a CDRH2, and a CDRH3 selected from the group consisting of SEQ ID NOs: 272, 273, and 274, respectively.

In one embodiment:

the VL1 comprises an amino acid sequence selected from the group consisting of SEQ ID NOs: 5, 9, 13, 17, 21, 25, 29, 33, 37, 41, 45, 49, and 53;

the VH1 comprises an amino acid sequence selected from the group consisting of SEQ ID NO: 6, 10, 14, 18, 22, 26, 30, 34, 38, 42, 46, 50, and 54;

the VL2 comprises an amino acid sequence selected from the group consisting of SEQ ID NO: 213, 217, 221, and 225;

the VH2 comprises an amino acid sequence selected from the group consisting of SEQ ID NO: 214, 218, 222, and 226.

In one embodiment:

1) the VL1 and VH1 are selected from the group consisting of:
  a) a VL1 comprising SEQ ID NO: 5 and a VH1 comprising SEQ ID NO: 6;
  b) a VL1 comprising SEQ ID NO: 9 and a VH1 comprising SEQ ID NO: 10;
  c) a VL1 comprising SEQ ID NO: 13 and a VH1 comprising SEQ ID NO: 14;
  d) a VL1 comprising SEQ ID NO: 17 and a VH1 comprising SEQ ID NO: 18;
  e) a VL1 comprising SEQ ID NO: 21 and a VH1 comprising SEQ ID NO: 22;
  f) a VL1 comprising SEQ ID NO: 25 and a VH1 comprising SEQ ID NO: 26;
  g) a VL1 comprising SEQ ID NO: 29 and a VH1 comprising SEQ ID NO: 30;
  h) a VL1 comprising SEQ ID NO: 33 and a VH1 comprising SEQ ID NO: 34;
  i) a VL1 comprising SEQ ID NO: 37 and a VH1 comprising SEQ ID NO: 38;
  j) a VL1 comprising SEQ ID NO: 41 and a VH1 comprising SEQ ID NO: 42;
  k) a VL1 comprising SEQ ID NO: 45 and a VH1 comprising SEQ ID NO: 46;
  l) a VL1 comprising SEQ ID NO: 49 and a VH1 comprising SEQ ID NO: 50; and
  m) a VL1 comprising SEQ ID NO: 53 and a VH1 comprising SEQ ID NO: 54;
and 2) the VL2 and VH2 are selected from the group consisting of:
  a) a VL2 comprising SEQ ID NO: 213 and a VH2 comprising SEQ ID NO: 214;
  b) a VL2 comprising SEQ ID NO: 217 and a VH2 comprising SEQ ID NO: 218;
  c) a VL2 comprising SEQ ID NO: 221 and a VH2 comprising SEQ ID NO: 222; and
  d) a VL2 comprising SEQ ID NO: 225 and a VH2 comprising SEQ ID NO: 226.

In one embodiment, the first antigen is human MSLN (SEQ ID NO: 2) and the second antigen is human CD40 (SEQ ID NO: 1); wherein:

the VL1 comprises a CDRL1, a CDRL2, and a CDRL3 selected from the group consisting of:
  SEQ ID NOs: 230, 231, and 232, respectively;
  SEQ ID NOs: 236, 237, and 238, respectively;
  SEQ ID NOs: 242, 243, and 244, respectively; and
  SEQ ID NOs: 248, 249, and 250, respectively;

the VH1 comprises a CDRH1, a CDRH2, and a CDRH3 selected from the group consisting of:
  SEQ ID NOs: 254, 255, and 256, respectively;
  SEQ ID NOs: 260, 261, and 262, respectively;
  SEQ ID NOs: 266, 267, and 268, respectively; and
  SEQ ID NOs: 272, 273, and 274, respectively;

the VL2 comprises a CDRL1, a CDRL2, and a CDRL3 selected from the group consisting of:
  SEQ ID NOs: 58, 59, and 60, respectively;
  SEQ ID NOs: 64, 65, and 66, respectively;
  SEQ ID NOs: 70, 71, and 72, respectively;
  SEQ ID NOs: 76, 77, and 78, respectively;
  SEQ ID NOs: 82, 83, and 84, respectively;
  SEQ ID NOs: 88, 89, and 90, respectively;
  SEQ ID NOs: 94, 95, and 96, respectively;
  SEQ ID NOs: 100, 101, and 102, respectively;
  SEQ ID NOs: 106, 107, and 108, respectively;
  SEQ ID NOs: 112, 113, and 114, respectively;
  SEQ ID NOs: 118, 119, and 120, respectively;
  SEQ ID NOs: 124, 125, and 126, respectively; and
  SEQ ID NOs: 130, 131, and 132, respectively;
and the VH2 comprises a CDRH1, a CDRH2, and a CDRH3 selected from the group consisting of:
  SEQ ID NOs: 136, 137, and 138, respectively;
  SEQ ID NOs: 142, 143, and 144, respectively;
  SEQ ID NOs: 148, 149, and 150, respectively;
  SEQ ID NOs: 154, 155, and 156, respectively;
  SEQ ID NOs: 160, 161, and 162, respectively;
  SEQ ID NOs: 166, 167, and 168, respectively;
  SEQ ID NOs: 172, 173, and 174, respectively;
  SEQ ID NOs: 178, 179, and 180, respectively;
  SEQ ID NOs: 184, 185, and 186, respectively;
  SEQ ID NOs: 190, 191, and 192, respectively;
  SEQ ID NOs: 196, 197, and 198, respectively;
  SEQ ID NOs: 202, 203, and 204, respectively; and
  SEQ ID NOs: 208, 209, and 210, respectively.

In one embodiment, 1) the VL1 and VH1 are selected from the group consisting of:
  a) a VL1 comprising a CDRL1, a CDRL2, and a CDRL3 selected from the group consisting of SEQ ID NOs: 230, 231, and 232, respectively; and a VH1 comprising a CDRH1, a CDRH2, and a CDRH3 selected from the group consisting of SEQ ID NOs: 254, 255, and 256, respectively;
  b) a VL1 comprising a CDRL1, a CDRL2, and a CDRL3 selected from the group consisting of SEQ ID NOs: 236, 237, and 238, respectively; and a VH1 comprising a CDRH1, a CDRH2, and a CDRH3 selected from the group consisting of SEQ ID NOs: 260, 261, and 262, respectively;
  c) a VL1 comprising a CDRL1, a CDRL2, and a CDRL3 selected from the group consisting of SEQ ID NOs: 242, 243, and 244, respectively; and a VH1 comprising a CDRH1, a CDRH2, and a CDRH3 selected from the group consisting of SEQ ID NOs: 266, 267, and 268, respectively; and
  d) a VL1 comprising a CDRL1, a CDRL2, and a CDRL3 selected from the group consisting of SEQ ID NOs: 248, 249, and 250, respectively; and a VH1 comprising a CDRH1, a CDRH2, and a CDRH3 selected from the group consisting of SEQ ID NOs: 272, 273, and 274, respectively;

and 2) the VL2 and VH2 are selected from the group consisting of:
- a) a VL2 comprising a CDRL1, a CDRL2, and a CDRL3 selected from the group consisting of SEQ ID NOs: 58, 59, and 60, respectively; and a VH2 comprising a CDRH1, a CDRH2, and a CDRH3 selected from the group consisting of SEQ ID NOs: 136, 137, and 138, respectively;
- b) a VL2 comprising a CDRL1, a CDRL2, and a CDRL3 selected from the group consisting of SEQ ID NOs: 64, 65, and 66, respectively; and a VH2 comprising a CDRH1, a CDRH2, and a CDRH3 selected from the group consisting of SEQ ID NOs: 142, 143, and 144, respectively;
- c) a VL2 comprising a CDRL1, a CDRL2, and a CDRL3 selected from the group consisting of SEQ ID NOs: 70, 71, and 72, respectively; and a VH2 comprising a CDRH1, a CDRH2, and a CDRH3 selected from the group consisting of SEQ ID NOs: 148, 149, and 150, respectively;
- d) a VL2 comprising a CDRL1, a CDRL2, and a CDRL3 selected from the group consisting of SEQ ID NOs: 76, 77, and 6780, respectively; and a VH2 comprising a CDRH1, a CDRH2, and a CDRH3 selected from the group consisting of SEQ ID NOs: 154, 155, and 156, respectively;
- e) a VL2 comprising a CDRL1, a CDRL2, and a CDRL3 selected from the group consisting of SEQ ID NOs: 82, 83, and 84, respectively; and a VH2 comprising a CDRH1, a CDRH2, and a CDRH3 selected from the group consisting of SEQ ID NOs: 160, 161, and 162, respectively;
- f) a VL2 comprising a CDRL1, a CDRL2, and a CDRL3 selected from the group consisting of SEQ ID NOs: 88, 89, and 90, respectively; and a VH2 comprising a CDRH1, a CDRH2, and a CDRH3 selected from the group consisting of SEQ ID NOs: 166, 167, and 168, respectively;
- g) a VL2 comprising a CDRL1, a CDRL2, and a CDRL3 selected from the group consisting of SEQ ID NOs: 94, 95, and 96, respectively; and a VH2 comprising a CDRH1, a CDRH2, and a CDRH3 selected from the group consisting of SEQ ID NOs: 172, 173, and 174, respectively;
- h) a VL2 comprising a CDRL1, a CDRL2, and a CDRL3 selected from the group consisting of SEQ ID NOs: 100, 101, and 102, respectively; and a VH2 comprising a CDRH1, a CDRH2, and a CDRH3 selected from the group consisting of SEQ ID NOs: 178, 179, and 180, respectively;
- i) a VL2 comprising a CDRL1, a CDRL2, and a CDRL3 selected from the group consisting of SEQ ID NOs: 106, 107, and 108, respectively; and a VH2 comprising a CDRH1, a CDRH2, and a CDRH3 selected from the group consisting of SEQ ID NOs: 184, 185, and 186, respectively;
- j) a VL2 comprising a CDRL1, a CDRL2, and a CDRL3 selected from the group consisting of SEQ ID NOs: 112, 113, and 114, respectively; and a VH2 comprising a CDRH1, a CDRH2, and a CDRH3 selected from the group consisting of SEQ ID NOs: 190, 191, and 192, respectively;
- k) a VL2 comprising a CDRL1, a CDRL2, and a CDRL3 selected from the group consisting of SEQ ID NOs: 118, 119, and 120, respectively; and a VH2 comprising a CDRH1, a CDRH2, and a CDRH3 selected from the group consisting of SEQ ID NOs: 196, 197, and 198, respectively;
- l) a VL2 comprising a CDRL1, a CDRL2, and a CDRL3 selected from the group consisting of SEQ ID NOs: 124, 125, and 126, respectively; and a VH2 comprising a CDRH1, a CDRH2, and a CDRH3 selected from the group consisting of SEQ ID NOs: 202, 203, and 204, respectively; and
- m) a VL2 comprising a CDRL1, a CDRL2, and a CDRL3 selected from the group consisting of SEQ ID NOs: 130, 131, and 132, respectively; and a VH2 comprising a CDRH1, a CDRH2, and a CDRH3 selected from the group consisting of SEQ ID NOs: 208, 209, and 210, respectively.

In one embodiment,
the VL1 comprises an amino acid sequence selected from the group consisting of SEQ ID NO: 213, 217, 221, and 225;
the VH1 comprises an amino acid sequence selected from the group consisting of SEQ ID NO: 214, 218, 222, and 226;
the VL2 comprises an amino acid sequence selected from the group consisting of SEQ ID NOs: 5, 9, 13, 17, 21, 25, 29, 33, 37, 41, 45, 49, and 53; and
the VH2 comprises an amino acid sequence selected from the group consisting of SEQ ID NO: 6, 10, 14, 18, 22, 26, 30, 34, 38, 42, 46, 50, and 54.

In one embodiment,
1) the VL1 and VH1 are selected from the group consisting of:
- a) a VL1 comprising SEQ ID NO: 213 and a VH1 comprising SEQ ID NO: 214;
- b) a VL1 comprising SEQ ID NO: 217 and a VH1 comprising SEQ ID NO: 218;
- c) a VL1 comprising SEQ ID NO: 221 and a VH1 comprising SEQ ID NO: 222; and
- d) a VL1 comprising SEQ ID NO: 225 and a VH1 comprising SEQ ID NO: 226;

and 2) the VL2 and VH2 are selected from the group consisting of:
- a) a VL2 comprising SEQ ID NO: 5 and a VH2 comprising SEQ ID NO: 6;
- b) a VL2 comprising SEQ ID NO: 9 and a VH2 comprising SEQ ID NO: 10;
- c) a VL2 comprising SEQ ID NO: 13 and a VH2 comprising SEQ ID NO: 14;
- d) a VL2 comprising SEQ ID NO: 17 and a VH2 comprising SEQ ID NO: 18;
- e) a VL2 comprising SEQ ID NO: 21 and a VH2 comprising SEQ ID NO: 22;
- f) a VL2 comprising SEQ ID NO: 25 and a VH2 comprising SEQ ID NO: 26;
- g) a VL2 comprising SEQ ID NO: 29 and a VH2 comprising SEQ ID NO: 30;
- h) a VL2 comprising SEQ ID NO: 33 and a VH2 comprising SEQ ID NO: 34;
- i) a VL2 comprising SEQ ID NO: 37 and a VH2 comprising SEQ ID NO: 38;
- j) a VL2 comprising SEQ ID NO: 41 and a VH2 comprising SEQ ID NO: 42;
- k) a VL2 comprising SEQ ID NO: 45 and a VH2 comprising SEQ ID NO: 46;
- l) a VL2 comprising SEQ ID NO: 49 and a VH2 comprising SEQ ID NO: 50; and
- m) a VL2 comprising SEQ ID NO: 53 and a VH2 comprising SEQ ID NO: 54.

The present invention includes one or more isolated nucleic acids encoding the multispecific antibody constructs and components thereof described herein. Nucleic acid molecules of the invention include DNA and RNA in both single-stranded and double-stranded form, as well as the corresponding complementary sequences. DNA includes, for example, cDNA, genomic DNA, chemically synthesized DNA, DNA amplified by PCR, and combinations thereof. The nucleic acid molecules of the invention include full-length genes or cDNA molecules as well as a combination of fragments thereof. In one embodiment, the nucleic acids of the invention are derived from human sources, but the invention includes those derived from non-human species, as well.

An "isolated nucleic acid," which is used interchangeably herein with "isolated polynucleotide," is a nucleic acid that has been separated from adjacent genetic sequences present in the genome of the organism from which the nucleic acid was isolated, in the case of nucleic acids isolated from naturally-occurring sources. In the case of nucleic acids synthesized enzymatically from a template or chemically, such as PCR products, cDNA molecules, or oligonucleotides for example, it is understood that the nucleic acids resulting from such processes are isolated nucleic acids. An isolated nucleic acid molecule refers to a nucleic acid molecule in the form of a separate fragment or as a component of a larger nucleic acid construct. In one embodiment, the nucleic acids are substantially free from contaminating endogenous material. The nucleic acid molecule has been derived from DNA or RNA isolated at least once in substantially pure form and in a quantity or concentration enabling identification, manipulation, and recovery of its component nucleotide sequences by standard biochemical methods (such as those outlined in Sambrook et al., Molecular Cloning: A Laboratory Manual, 2nd ed., Cold Spring Harbor Laboratory, Cold Spring Harbor, NY (1989)). Such sequences are provided and/or constructed in the form of an open reading frame uninterrupted by internal non-translated sequences, or introns, that are typically present in eukaryotic genes. Sequences of non-translated DNA can be present 5' or 3' from an open reading frame, where the same do not interfere with manipulation or expression of the coding region. Unless specified otherwise, the left-hand end of any single-stranded polynucleotide sequence discussed herein is the 5' end; the left-hand direction of double-stranded polynucleotide sequences is referred to as the 5' direction. The direction of 5' to 3' production of nascent RNA transcripts is referred to as the transcription direction; sequence regions on the DNA strand having the same sequence as the RNA transcript that are 5' to the 5' end of the RNA transcript are referred to as "upstream sequences;" sequence regions on the DNA strand having the same sequence as the RNA transcript that are 3' to the 3' end of the RNA transcript are referred to as "downstream sequences."

In one aspect, the present invention is directed to a polynucleotide encoding the light chain of the antibody construct of the present invention.

In one aspect, the present invention is directed to a polynucleotide encoding the heavy chain fusion protein of the antibody construct of the present invention.

In one aspect, the present invention is directed to a vector comprising the polynucleotide encoding the light chain of the antibody construct, the polynucleotide encoding the heavy chain of the antibody construct, or both.

In one aspect, the present invention is directed to a host cell transformed or transfected with the vector or the polynucleotide encoding the light chain of the antibody construct and the polynucleotide encoding the heavy chain of the antibody construct.

In one aspect, the present invention is directed to a process for producing the antibody construct of the present invention, the process comprising culturing a host cell comprising a polynucleotide encoding the light chain and also comprising a polynucleotide encoding the heavy chain fusion protein under conditions allowing the expression of the antibody construct, and recovering the produced antibody construct from the culture.

Variants of the antigen binding proteins described herein can be prepared by site-specific mutagenesis of nucleotides in the DNA encoding the polypeptide, using cassette or PCR mutagenesis or other techniques well known in the art, to produce DNA encoding the variant, and thereafter expressing the recombinant DNA in cell culture as outlined herein. However, antigen binding proteins comprising variant CDRs having up to about 100-150 residues may be prepared by in vitro synthesis using established techniques. The variants typically exhibit the same qualitative biological activity as the naturally occurring analogue, e.g., binding to antigen. Such variants include, for example, deletions and/or insertions and/or substitutions of residues within the amino acid sequences of the antigen binding proteins. Any combination of deletion, insertion, and substitution is made to arrive at the final construct, provided that the final construct possesses the desired characteristics. The amino acid changes also may alter post-translational processes of the antigen binding protein, such as changing the number or position of glycosylation sites. In certain embodiments, antigen binding protein variants are prepared with the intent to modify those amino acid residues which are directly involved in epitope binding. In other embodiments, modification of residues which are not directly involved in epitope binding or residues not involved in epitope binding in any way, is desirable, for purposes discussed herein. Mutagenesis within any of the CDR regions and/or framework regions is contemplated. Covariance analysis techniques can be employed by the skilled artisan to design useful modifications in the amino acid sequence of the antigen binding protein. See, e.g., Choulier, et al., Proteins 41:475-484, 2000; Demarest et al., J. Mol. Biol. 335:41-48, 2004; Hugo et al., Protein Engineering 16(5):381-86, 2003; Aurora et al., US Patent Publication No. 2008/0318207 A1; Glaser et al., US Patent Publication No. 2009/0048122 A1; Urech et al., WO 2008/110348 A1; Borras et al., WO 2009/000099 A2. Such modifications determined by covariance analysis can improve potency, pharmacokinetic, pharmacodynamic, and/or manufacturability characteristics of an antigen binding protein.

The nucleic acid sequences of the present invention. As will be appreciated by those in the art, due to the degeneracy of the genetic code, an extremely large number of nucleic acids may be made, all of which encode the CDRs (and heavy and light chains or other components of the antigen binding proteins described herein) of the invention. Thus, having identified a particular amino acid sequence, those skilled in the art could make any number of different nucleic acids, by simply modifying the sequence of one or more codons in a way which does not change the amino acid sequence of the encoded protein.

The present invention also includes vectors comprising one or more nucleic acids encoding one or more components of the multispecific antibody constructs of the invention (e.g. variable regions, light chains, heavy chains, modified heavy chains, and Fd fragments). The term "vector" refers to any molecule or entity (e.g., nucleic acid, plasmid, bacteriophage or virus) used to transfer protein coding information into a host cell. Examples of vectors include, but are not limited to, plasmids, viral vectors, non-episomal mammalian vectors and expression vectors, for example, recombinant expression vectors. The term "expression vector" or "expression construct" as used herein refers to a recombinant DNA molecule containing a desired coding sequence and appropriate nucleic acid control sequences necessary for the expression of the operably linked coding sequence in a particular host cell. An expression vector can include, but is not limited to, sequences that affect or control transcription, translation, and, if introns are present, affect RNA splicing of a coding region operably linked thereto. Nucleic acid sequences necessary for expression in prokaryotes include a promoter, optionally an operator sequence, a ribosome binding site and possibly other sequences. Eukaryotic cells are known to utilize promoters, enhancers, and termination and polyadenylation signals. A secretory signal peptide sequence can also, optionally, be encoded by the expression vector, operably linked to the coding sequence of interest, so that the expressed polypeptide can be secreted by the recombinant host cell, for more facile isolation of the polypeptide of interest from the cell, if desired. For instance, in some embodiments, signal peptide sequences may be appended/fused to the amino terminus of any of the polypeptides sequences of the present invention. In certain embodiments, a signal peptide having the amino acid sequence of MDMRVPAQLLGLLLLWLRGARC (SEQ ID NO: 894) is fused to the amino terminus of any of the polypeptide sequences of the present invention. In other embodiments, a signal peptide having the amino acid sequence of MAWALLLTLLTQGTGSWA (SEQ ID NO: 895) is fused to the amino terminus of any of the polypeptide sequences of the present invention. In still other embodiments, a signal peptide having the amino acid sequence of MTCSPLLLTL-LIHCTGSWA (SEQ ID NO: 896) is fused to the amino terminus of any of the polypeptide sequences of the present invention. Other suitable signal peptide sequences that can be fused to the amino terminus of the polypeptide sequences described herein include: MEAPAQLLFLLLLWLPDTTG (SEQ ID NO: 897), MEWTWRVLFLVAAATGAHS (SEQ ID NO: 898), METPAQLLFLLLLWLPDTTG (SEQ ID NO: 899), METPAQLLFLLLLWLPDTTG (SEQ ID NO: 900), MKHLWFFLLLVAAPRWVLS (SEQ ID NO: 901), and MEWSWVFLFFLSVTTGVHS (SEQ ID NO: 902). Other signal peptides are known to those of skill in the art and may be fused to any of the polypeptide chains of the present invention, for example, to facilitate or optimize expression in particular host cells.

Typically, expression vectors used in the host cells to produce the bispecific antigen proteins of the invention will contain sequences for plasmid maintenance and for cloning and expression of exogenous nucleotide sequences encoding the components of the multispecific antibody constructs. Such sequences, collectively referred to as "flanking sequences," in certain embodiments will typically include one or more of the following nucleotide sequences: a promoter, one or more enhancer sequences, an origin of replication, a transcriptional termination sequence, a complete intron sequence containing a donor and acceptor splice site, a sequence encoding a leader sequence for polypeptide secretion, a ribosome binding site, a polyadenylation sequence, a polylinker region for inserting the nucleic acid encoding the polypeptide to be expressed, and a selectable marker element. Each of these sequences is discussed below.

Optionally, the vector may contain a "tag"-encoding sequence, i.e., an oligonucleotide molecule located at the 5' or 3' end of the polypeptide coding sequence; the oligonucleotide tag sequence encodes polyHis (such as hexaHis (SEQ ID NO: 925)), FLAG, HA (hemaglutinin influenza virus), myc, or another "tag" molecule for which commercially available antibodies exist. This tag is typically fused to the polypeptide upon expression of the polypeptide, and can serve as a means for affinity purification or detection of the polypeptide from the host cell. Affinity purification can be accomplished, for example, by column chromatography using antibodies against the tag as an affinity matrix. Optionally, the tag can subsequently be removed from the purified polypeptide by various means such as using certain peptidases for cleavage.

Flanking sequences may be homologous (i.e., from the same species and/or strain as the host cell), heterologous (i.e., from a species other than the host cell species or strain), hybrid (i.e., a combination of flanking sequences from more than one source), synthetic or native. As such, the source of a flanking sequence may be any prokaryotic or eukaryotic organism, any vertebrate or invertebrate organism, or any plant, provided that the flanking sequence is functional in, and can be activated by, the host cell machinery.

Flanking sequences useful in the vectors of this invention may be obtained by any of several methods well known in the art. Typically, flanking sequences useful herein will have been previously identified by mapping and/or by restriction endonuclease digestion and can thus be isolated from the proper tissue source using the appropriate restriction endonucleases. In some cases, the full nucleotide sequence of a flanking sequence may be known. Here, the flanking sequence may be synthesized using routine methods for nucleic acid synthesis or cloning.

Whether all or only a portion of the flanking sequence is known, it may be obtained using polymerase chain reaction (PCR) and/or by screening a genomic library with a suitable probe such as an oligonucleotide and/or flanking sequence fragment from the same or another species. Where the flanking sequence is not known, a fragment of DNA containing a flanking sequence may be isolated from a larger piece of DNA that may contain, for example, a coding sequence or even another gene or genes. Isolation may be accomplished by restriction endonuclease digestion to produce the proper DNA fragment followed by isolation using agarose gel purification, Qiagen® column chromatography (Chatsworth, CA), or other methods known to the skilled artisan. The selection of suitable enzymes to accomplish this purpose will be readily apparent to one of ordinary skill in the art.

An origin of replication is typically a part of those prokaryotic expression vectors purchased commercially, and the origin aids in the amplification of the vector in a host cell. If the vector of choice does not contain an origin of replication site, one may be chemically synthesized based on a known sequence, and ligated into the vector. For example, the origin of replication from the plasmid pBR322 (New England Biolabs, Beverly, MA) is suitable for most gram-negative bacteria, and various viral origins (e.g., SV40, polyoma, adenovirus, vesicular stomatitus virus (VSV), or papillomaviruses such as HPV or BPV) are useful for cloning vectors in mammalian cells. Generally, the origin of replication component is not needed for mammalian expression vectors (for example, the SV40 origin is often used only because it also contains the virus early promoter).

A transcription termination sequence is typically located 3' to the end of a polypeptide coding region and serves to terminate transcription. Usually, a transcription termination sequence in prokaryotic cells is a G-C rich fragment followed by a poly-T sequence. While the sequence is easily cloned from a library or even purchased commercially as part of a vector, it can also be readily synthesized using known methods for nucleic acid synthesis.

A selectable marker gene encodes a protein necessary for the survival and growth of a host cell grown in a selective culture medium. Typical selection marker genes encode proteins that (a) confer resistance to antibiotics or other toxins, e.g., ampicillin, tetracycline, or kanamycin for prokaryotic host cells; (b) complement auxotrophic deficiencies of the cell; or (c) supply critical nutrients not available from complex or defined media. Specific selectable markers are the kanamycin resistance gene, the ampicillin resistance gene, and the tetracycline resistance gene. Advantageously, a neomycin resistance gene may also be used for selection in both prokaryotic and eukaryotic host cells.

Other selectable genes may be used to amplify the gene that will be expressed. Amplification is the process wherein genes that are required for production of a protein critical for growth or cell survival are reiterated in tandem within the chromosomes of successive generations of recombinant cells. Examples of suitable selectable markers for mammalian cells include dihydrofolate reductase (DHFR) and promoterless thymidine kinase genes Mammalian cell transformants are placed under selection pressure wherein only the transformants are uniquely adapted to survive by virtue of the selectable gene present in the vector. Selection pressure is imposed by culturing the transformed cells under conditions in which the concentration of selection agent in the medium is successively increased, thereby leading to the amplification of both the selectable gene and the DNA that encodes another gene, such as one or more components of the multispecific antibody constructs described herein. As a result, increased quantities of a polypeptide are synthesized from the amplified DNA.

A ribosome-binding site is usually necessary for translation initiation of mRNA and is characterized by a Shine-Dalgarno sequence (prokaryotes) or a Kozak sequence (eukaryotes). The element is typically located 3' to the promoter and 5' to the coding sequence of the polypeptide to be expressed. In certain embodiments, one or more coding regions may be operably linked to an internal ribosome binding site (IRES), allowing translation of two open reading frames from a single RNA transcript.

In some cases, such as where glycosylation is desired in a eukaryotic host cell expression system, one may manipulate the various pre- or prosequences to improve glycosylation or yield. For example, one may alter the peptidase cleavage site of a particular signal peptide, or add prosequences, which also may affect glycosylation. The final protein product may have, in the −1 position (relative to the first amino acid of the mature protein) one or more additional amino acids incident to expression, which may not have been totally removed. For example, the final protein product may have one or two amino acid residues found in the peptidase cleavage site, attached to the amino-terminus. Alternatively, use of some enzyme cleavage sites may result in a slightly truncated form of the desired polypeptide, if the enzyme cuts at such area within the mature polypeptide.

Expression and cloning vectors of the invention will typically contain a promoter that is recognized by the host organism and operably linked to the molecule encoding the polypeptide. The term "operably linked" as used herein refers to the linkage of two or more nucleic acid sequences in such a manner that a nucleic acid molecule capable of directing the transcription of a given gene and/or the synthesis of a desired protein molecule is produced. For example, a control sequence in a vector that is "operably linked" to a protein coding sequence is ligated thereto so that expression of the protein coding sequence is achieved under conditions compatible with the transcriptional activity of the control sequences. More specifically, a promoter and/or enhancer sequence, including any combination of cis-acting transcriptional control elements is operably linked to a coding sequence if it stimulates or modulates the transcription of the coding sequence in an appropriate host cell or other expression system.

Promoters are untranscribed sequences located upstream (i.e., 5') to the start codon of a structural gene (generally within about 100 to 1000 bp) that control transcription of the structural gene. Promoters are conventionally grouped into one of two classes: inducible promoters and constitutive promoters. Inducible promoters initiate increased levels of transcription from DNA under their control in response to some change in culture conditions, such as the presence or absence of a nutrient or a change in temperature. Constitutive promoters, on the other hand, uniformly transcribe a gene to which they are operably linked, that is, with little or no control over gene expression. A large number of promoters, recognized by a variety of potential host cells, are well known. A suitable promoter is operably linked to the DNA encoding e.g., heavy chain, light chain, modified heavy chain, or other component of the multispecific antibody constructs of the invention, by removing the promoter from the source DNA by restriction enzyme digestion and inserting the desired promoter sequence into the vector.

Suitable promoters for use with yeast hosts are also well known in the art. Yeast enhancers are advantageously used with yeast promoters. Suitable promoters for use with mammalian host cells are well known and include, but are not limited to, those obtained from the genomes of viruses such as polyoma virus, fowlpox virus, adenovirus (such as Adenovirus 2), bovine papilloma virus, avian sarcoma virus, cytomegalovirus, retroviruses, hepatitis-B virus and Simian Virus 40 (SV40). Other suitable mammalian promoters include heterologous mammalian promoters, for example, heat-shock promoters and the actin promoter.

Additional promoters which may be of interest include, but are not limited to: SV40 early promoter (Benoist and Chambon, 1981, Nature 290:304-310); CMV promoter (Thornsen et al., 1984, Proc. Natl. Acad. U.S.A. 81:659-663); the promoter contained in the 3' long terminal repeat of Rous sarcoma virus (Yamamoto et al., 1980, Cell 22:787-797); herpes thymidine kinase promoter (Wagner et al., 1981, Proc. Natl. Acad. Sci. U.S.A. 78: 1444-1445); promoter and regulatory sequences from the metallothionine gene Prinster et al., 1982, Nature 296:39-42); and prokaryotic promoters such as the beta-lactamase promoter (Villa-Kamaroff et al., 1978, Proc. Natl. Acad. Sci. U.S.A. 75:3727-3731); or the tac promoter (DeBoer et al., 1983, Proc. Natl. Acad. Sci. U.S.A. 80:21-25). Also of interest are the following animal transcriptional control regions, which exhibit tissue specificity and have been utilized in transgenic animals: the elastase I gene control region that is active in pancreatic acinar cells (Swift et al., 1984, Cell 38:639-646; Ornitz et al., 1986, Cold Spring Harbor Symp. Quant. Biol. 50:399-409; MacDonald, 1987, Hepatology 7:425-515); the insulin gene control region that is active in pancreatic beta cells (Hanahan, 1985, Nature 315: 115-122); the immunoglobulin gene control region that is active in lymphoid cells (Grosschedl et al., 1984, Cell 38:647-658; Adames et al., 1985, Nature 318:533-538; Alexander et al., 1987, Mol.

Cell. Biol. 7: 1436-1444); the mouse mammary tumor virus control region that is active in testicular, breast, lymphoid and mast cells (Leder et al., 1986, Cell 45:485-495); the albumin gene control region that is active in liver (Pinkert et al., 1987, Genes and Devel. 1:268-276); the alpha-feto-protein gene control region that is active in liver (Krumlauf et al., 1985, Mol. Cell. Biol. 5: 1639-1648; Hammer et al., 1987, Science 253:53-58); the alpha 1-antitrypsin gene control region that is active in liver (Kelsey et al., 1987, Genes and Devel. 1: 161-171); the beta-globin gene control region that is active in myeloid cells (Mogram et al, 1985, Nature 315:338-340; Kollias et al, 1986, Cell 46:89-94); the myelin basic protein gene control region that is active in oligodendrocyte cells in the brain (Readhead et al., 1987, Cell 48:703-712); the myosin light chain-2 gene control region that is active in skeletal muscle (Sani, 1985, Nature 314:283-286); and the gonadotropic releasing hormone gene control region that is active in the hypothalamus (Mason et al., 1986, Science 234: 1372-1378).

An enhancer sequence may be inserted into the vector to increase transcription of DNA encoding a component of the multispecific antibody constructs (e.g., light chain, heavy chain, modified heavy chain, Fd fragment) by higher eukaryotes. Enhancers are cis-acting elements of DNA, usually about 10-300 bp in length, that act on the promoter to increase transcription. Enhancers are relatively orientation and position independent, having been found at positions both 5' and 3' to the transcription unit. Several enhancer sequences available from mammalian genes are known (e.g., globin, elastase, albumin, alpha-feto-protein and insulin). Typically, however, an enhancer from a virus is used. The SV40 enhancer, the cytomegalovirus early promoter enhancer, the polyoma enhancer, and adenovirus enhancers known in the art are exemplary enhancing elements for the activation of eukaryotic promoters. While an enhancer may be positioned in the vector either 5' or 3' to a coding sequence, it is typically located at a site 5' from the promoter. A sequence encoding an appropriate native or heterologous signal sequence (leader sequence or signal peptide) can be incorporated into an expression vector, to promote extracellular secretion of the antibody. The choice of signal peptide or leader depends on the type of host cells in which the antibody is to be produced, and a heterologous signal sequence can replace the native signal sequence. Examples of signal peptides are described above. Other signal peptides that are functional in mammalian host cells include the signal sequence for interleukin-7 (IL-7) described in U.S. Pat. No. 4,965,195; the signal sequence for interleukin-2 receptor described in Cosman et al., 1984, Nature 312:768; the interleukin-4 receptor signal peptide described in EP Patent No. 0367 566; the type I interleukin-1 receptor signal peptide described in U.S. Pat. No. 4,968,607; the type II interleukin-1 receptor signal peptide described in EP Patent No. 0 460 846.

The expression vectors that are provided may be constructed from a starting vector such as a commercially available vector. Such vectors may or may not contain all of the desired flanking sequences. Where one or more of the flanking sequences described herein are not already present in the vector, they may be individually obtained and ligated into the vector. Methods used for obtaining each of the flanking sequences are well known to one skilled in the art. The expression vectors can be introduced into host cells to thereby produce proteins, including fusion proteins, encoded by nucleic acids as described herein.

In certain embodiments, nucleic acids encoding the different components of the multispecific antibody constructs of the invention may be inserted into the same expression vector. For instance, the nucleic acid encoding an anti-first target antigen light chain can be cloned into the same vector as the nucleic acid encoding an anti-first target antigen heavy chain. In such embodiments, the two nucleic acids may be separated by an internal ribosome entry site (IRES) and under the control of a single promoter such that the light chain and heavy chain are expressed from the same mRNA transcript. Alternatively, the two nucleic acids may be under the control of two separate promoters such that the light chain and heavy chain are expressed from two separate mRNA transcripts. In some embodiments, nucleic acids encoding the anti-first target antigen light chain and heavy chain are cloned into one expression vector and the nucleic acids encoding the anti-second target antigen light chain and heavy chain are cloned into a second expression vector.

Similarly, for IgG-Fab multispecific antibody constructs, nucleic acids encoding each of the three components may be cloned into the same expression vector. In some embodiments, the nucleic acid encoding the light chain of the IgG-Fab molecule and the nucleic acid encoding the second polypeptide (which comprises the other half of the C-terminal Fab domain) are cloned into one expression vector, whereas the nucleic acid encoding the modified heavy chain (fusion protein comprising a heavy chain and half of a Fab domain) is cloned into a second expression vector. In certain embodiments, all components of the multispecific antibody constructs described herein are expressed from the same host cell population. For example, even if one or more components is cloned into a separate expression vector, the host cell is co-transfected with both expression vectors such that one cell produces all components of the multispecific antibody constructs.

After the vector has been constructed and the one or more nucleic acid molecules encoding the components of the multispecific antibody constructs described herein has been inserted into the proper site(s) of the vector or vectors, the completed vector(s) may be inserted into a suitable host cell for amplification and/or polypeptide expression. Thus, the present invention encompasses an isolated host cell comprising one or more expression vectors encoding the components of the multispecific antibody constructs. The term "host cell" as used herein refers to a cell that has been transformed, or is capable of being transformed, with a nucleic acid and thereby expresses a gene of interest. The term includes the progeny of the parent cell, whether or not the progeny is identical in morphology or in genetic make-up to the original parent cell, so long as the gene of interest is present. A host cell that comprises an isolated nucleic acid of the invention, in one embodiment operably linked to at least one expression control sequence (e.g. promoter or enhancer), is a "recombinant host cell."

The transformation of an expression vector for an antigen binding protein into a selected host cell may be accomplished by well-known methods including transfection, infection, calcium phosphate co-precipitation, electroporation, microinjection, lipofection, DEAE-dextran mediated transfection, or other known techniques. The method selected will in part be a function of the type of host cell to be used. These methods and other suitable methods are well known to the skilled artisan, and are set forth, for example, in Sambrook et al., 2001, supra.

A host cell, when cultured under appropriate conditions, synthesizes an antigen binding protein that can subsequently be collected from the culture medium (if the host cell secretes it into the medium) or directly from the host cell producing it (if it is not secreted). The selection of an appropriate host cell will depend upon various factors, such as desired expression levels, polypeptide modifications that are desirable or necessary for activity (such as glycosylation or phosphorylation) and ease of folding into a biologically active molecule.

Exemplary host cells include prokaryote, yeast, or higher eukaryote cells. Prokaryotic host cells include eubacteria, such as Gram-negative or Gram-positive organisms, for example, Enterobacteriaceae such as *Escherichia*, e.g., *E. coli, Enterobacter, Erwinia, Klebsiella, Proteus, Salmonella*, e.g., *Salmonella typhimurium, Serratia*, e.g., *Serratia marcescans*, and *Shigella*, as well as *Bacillus*, such as *B. subtilis* and *B. licheniformis, Pseudomonas*, and *Streptomyces*. Eukaryotic microbes such as filamentous fungi or yeast are suitable cloning or expression hosts for recombinant polypeptides. *Saccharomyces cerevisiae*, or common baker's yeast, is the most commonly used among lower eukaryotic host microorganisms. However, a number of other genera, species, and strains are commonly available and useful herein, such as *Pichia*, e.g. *P. pastoris, Schizosaccharomyces pombe; Kluyveromyces, Yarrowia; Candida; Trichoderma reesia; Neurospora crassa; Schwanniomyces*, such as *Schwanniomyces occidentalis*; and filamentous fungi, such as, e.g., *Neurospora, Penicillium, Tolypocladium*, and *Aspergillus* hosts such as *A. nidulans* and *A. niger*.

Host cells for the expression of glycosylated antigen binding proteins can be derived from multicellular organisms. Examples of invertebrate cells include plant and insect cells. Numerous baculoviral strains and variants and corresponding permissive insect host cells from hosts such as *Spodoptera frupperda* (caterpillar), *Aedes aegypti* (mosquito), *Aedes albopictus* (mosquito), *Drosophila melanogaster* (fruitfly), and *Bombyx mori* have been identified. A variety of viral strains for transfection of such cells are publicly available, e.g., the L-1 variant of *Autographa californica* NPV and the Bm-5 strain of *Bombyx mori* NPV.

Vertebrate host cells are also suitable hosts, and recombinant production of antigen binding proteins from such cells has become routine procedure Mammalian cell lines available as hosts for expression are well known in the art and include, but are not limited to, immortalized cell lines available from the American Type Culture Collection (ATCC), including but not limited to Chinese hamster ovary (CHO) cells, including CHOK1 cells (ATCC CCL61), DXB-11, DG-44, and Chinese hamster ovary cells/-DHFR (CHO, Urlaub et al., Proc. Natl. Acad. Sci. USA 77: 4216, 1980); monkey kidney CV1 line transformed by SV40 (COS-7, ATCC CRL 1651); human embryonic kidney line (293 or 293 cells subcloned for growth in suspension culture, (Graham et al., J. Gen Virol. 36: 59, 1977); baby hamster kidney cells (BHK, ATCC CCL 10); mouse sertoli cells (TM4, Mather, Biol. Reprod. 23: 243-251, 1980); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human hepatoma cells (Hep G2, HB 8065); mouse mammary tumor (MMT 060562, ATCC CCL51); TRI cells (Mather et al., Annals N Y Acad. Sci. 383: 44-68, 1982); MRC 5 cells or FS4 cells; mammalian myeloma cells, and a number of other cell lines. In certain embodiments, cell lines may be selected through determining which cell lines have high expression levels and constitutively produce multispecific antibody constructs of the present invention. In another embodiment, a cell line from the B cell lineage that does not make its own antibody but has a capacity to make and secrete a heterologous antibody can be selected. CHO cells are host cells in some embodiments for expressing the multispecific antibody constructs of the invention.

Host cells are transformed or transfected with the above-described nucleic acids or vectors for production of multi-specific antibody constructs and are cultured in conventional nutrient media modified as appropriate for inducing promoters, selecting transformants, or amplifying the genes encoding the desired sequences. In addition, novel vectors and transfected cell lines with multiple copies of transcription units separated by a selective marker are particularly useful for the expression of antigen binding proteins. Thus, the present invention also provides a method for preparing a multispecific antibody construct described herein comprising culturing a host cell comprising one or more expression vectors described herein in a culture medium under conditions permitting expression of the multispecific antibody construct encoded by the one or more expression vectors; and recovering the multispecific antibody construct from the culture medium.

The host cells used to produce the antigen binding proteins of the invention may be cultured in a variety of media. Commercially available media such as Ham's F10 (Sigma), Minimal Essential Medium ((MEM), (Sigma), RPMI-1640 (Sigma), and Dulbecco's Modified Eagle's Medium ((DMEM), Sigma) are suitable for culturing the host cells. In addition, any of the media described in Ham et al., Meth. Enz. 58: 44, 1979; Barnes et al., Anal. Biochem. 102: 255, 1980; U.S. Pat. Nos. 4,767,704; 4,657,866; 4,927,762; 4,560,655; or 5,122,469; WO90/03430; WO 87/00195; or U.S. Pat. Re. No. 30,985 may be used as culture media for the host cells. Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleotides (such as adenosine and thymidine), antibiotics (such as Gentamycin™ drug), trace elements (defined as inorganic compounds usually present at final concentrations in the micromolar range), and glucose or an equivalent energy source. Any other necessary supplements may also be included at appropriate concentrations that would be known to those skilled in the art. The culture conditions, such as temperature, pH, and the like, are those previously used with the host cell selected for expression, and will be apparent to the ordinarily skilled artisan.

Upon culturing the host cells, the multispecific antibody construct can be produced intracellularly, in the periplasmic space, or directly secreted into the medium. If the antigen binding protein is produced intracellularly, as a first step, the particulate debris, either host cells or lysed fragments, is removed, for example, by centrifugation or ultrafiltration. The bispecifc antigen binding protein can be purified using, for example, hydroxyapatite chromatography, cation or anion exchange chromatography, or affinity chromatography, using the antigen(s) of interest or protein A or protein G as an affinity ligand. Protein A can be used to purify proteins that include polypeptides that are based on human γ1, γ2, or γ4 heavy chains (Lindmark et al., J. Immunol. Meth. 62: 1-13, 1983). Protein G is recommended for all mouse isotypes and for human γ3 (Guss et al., EMBO J. 5: 15671575, 1986). The matrix to which the affinity ligand is attached is most often agarose, but other matrices are available. Mechanically stable matrices such as controlled pore glass or poly(styrenedivinyl)benzene allow for faster flow rates and shorter processing times than can be achieved with agarose. Where the protein comprises a CH3 domain, the Bakerbond ABX™ resin (J. T. Baker, Phillipsburg, NJ) is useful for purification. Other techniques for protein purification such as ethanol precipitation, Reverse Phase HPLC, chromatofocusing, SDS-PAGE, and ammonium sulfate precipitation are also possible depending on the particular multispecific antibody construct to be recovered.

The multispecific antibody constructs of the invention are useful for detecting target antigen(s) in biological samples and identification of cells or tissues that express the target antigen(s). The multispecific antibody constructs described herein can be used for diagnostic purposes to detect, diagnose, or monitor diseases and/or conditions associated with the target antigen(s). Also provided are methods for the detection of the presence of the target antigen(s) in a sample using classical immunohistological methods known to those of skill in the art (e.g., Tijssen, 1993, Practice and Theory of Enzyme Immunoassays, Vol 15 (Eds R. H. Burdon and P. H. van Knippenberg, Elsevier, Amsterdam); Zola, 1987, Monoclonal Antibodies: A Manual of Techniques, pp. 147-158 (CRC Press, Inc.); Jalkanen et al., 1985, J. Cell. Biol. 101:976-985; Jalkanen et al., 1987, J. Cell Biol. 105:3087-3096). The detection of either target can be performed in vivo or in vitro.

One embodiment provides the multispecific antibody construct of the invention or the multispecific antibody construct produced according to the process of the invention for use in the prevention, treatment or amelioration of a tumor or cancer disease or of a metastatic cancer disease.

According to a preferred embodiment of the invention said tumor or cancer disease is a solid tumor disease.

The formulations described herein are useful as pharmaceutical compositions in the treatment, amelioration and/or prevention of the pathological medical condition as described herein in a patient in need thereof. The term "treatment" refers to both therapeutic treatment and prophylactic or preventative measures. Treatment includes the application or administration of the formulation to the body, an isolated tissue, or cell from a patient who has a disease/disorder, a symptom of a disease/disorder, or a predisposition toward a disease/disorder, with the purpose to cure, heal, alleviate, relieve, alter, remedy, ameliorate, improve, or affect the disease, the symptom of the disease, or the predisposition toward the disease.

The term "amelioration" as used herein refers to any improvement of the disease state of a patient having a tumor or cancer or a metastatic cancer as specified herein below, by the administration of an multispecific antibody construct according to the invention to a subject in need thereof. Such an improvement may also be seen as a slowing or stopping of the p progression of the tumor or cancer or metastatic cancer of the patient. The term "prevention" as used herein means the avoidance of the occurrence or re-occurrence of a patient having a tumor or cancer or a metastatic cancer as specified herein below, by the administration of an multispecific antibody construct according to the invention to a subject in need thereof.

The term "disease" refers to any condition that would benefit from treatment with the multispecific antibody construct or the pharmaceutic composition described herein. This includes chronic and acute disorders or diseases including those pathological conditions that predispose the mammal to the disease in question. A "neoplasm" is is an abnormal growth of tissue, usually but not always forming a mass. When also forming a mass, it is commonly referred to as a "tumor". Neoplasms or tumors or can be benign, potentially malignant (pre-cancerous), or malignant. Malignant neoplasms are commonly called cancer. They usually invade and destroy the surrounding tissue and may form metastases, i.e., they spread to other parts, tissues or organs of the body. Hence, the term "metastatic cancer" encompasses metastases to other tissues or organs than the one of the original tumor. Lymphomas and leukemias are lymphoid neoplasms. For the purposes of the present invention, they are also encompassed by the terms "tumor" or "cancer".

In a preferred embodiment of the invention, the tumor or cancer disease is a solid tumor disease and the metastatic cancer disease can be derived from any of the foregoing.

Preferred tumor or cancer diseases in connection with this invention are selected from a group consisting of breast cancer, Carcinoid, cervical cancer, colorectal cancer, endometrial cancer, gastric cancer, head and neck cancer, mesothelioma, liver cancer, lung cancer, ovarian cancer, pancreatic cancer, prostate cancer, skin cancer, renal cancer and stomach cancer. More preferably, the tumor or cancer disease, which is preferably a solid tumor disease, can be selected from the group consisting of ovarian cancer, pancreatic cancer, mesothelioma, lung cancer, gastric cancer and triple negative breast cancer. The metastatic cancer disease can be derived from any of the foregoing.

The invention also provides a method for the treatment or amelioration of tumor or cancer disease or a metastatic cancer disease, comprising the step of administering to a subject in need thereof the multispecific antibody construct of the invention or the multispecific antibody construct produced according to the process of the invention.

The terms "subject in need" or those "in need of treatment" includes those already with the disorder, as well as those in which the disorder is to be prevented. The subject in need or "patient" includes human and other mammalian subjects that receive either prophylactic or therapeutic treatment.

The multispecific antibody construct of the invention will generally be designed for specific routes and methods of administration, for specific dosages and frequencies of administration, for specific treatments of specific diseases, with ranges of bio-availability and persistence, among other things. The materials of the composition are preferably formulated in concentrations that are acceptable for the site of administration.

Formulations and compositions thus may be designed in accordance with the invention for delivery by any suitable route of administration. In the context of the present invention, the routes of administration include, but are not limited to topical routes (such as epicutaneous, inhalational, nasal, opthalmic, auricular/aural, vaginal, mucosal);
enteral routes (such as oral, gastrointestinal, sublingual, sublabial, buccal, rectal); and
parenteral routes (such as intravenous, intraarterial, intraosseous, intramuscular, intracerebral, intracerebroventricular, epidural, intrathecal, subcutaneous, intraperitoneal, extra-amniotic, intraarticular, intracardiac, intradermal, intralesional, intrauterine, intravesical, intravitreal, transdermal, intranasal, transmucosal, intrasynovial, intraluminal).

The pharmaceutical compositions and the multispecific antibody construct of this invention are particularly useful for parenteral administration, e.g., subcutaneous or intravenous delivery, for example by injection such as bolus injection, or by infusion such as continuous infusion. Pharmaceutical compositions may be administered using a medical device. Examples of medical devices for administering pharmaceutical compositions are described in U.S. Pat. Nos.

4,475,196; 4,439,196; 4,447,224; 4,447, 233; 4,486,194; 4,487,603; 4,596,556; 4,790,824; 4,941,880; 5,064,413; 5,312,335; 5,312,335; 5,383,851; and 5,399,163.

In particular, the present invention provides for an uninterrupted administration of the suitable composition. As a non-limiting example, uninterrupted or substantially uninterrupted, i.e. continuous administration may be realized by a small pump system worn by the patient for metering the influx of therapeutic agent into the body of the patient. The pharmaceutical composition comprising the multispecific antibody construct of the invention can be administered by using said pump systems. Such pump systems are generally known in the art, and commonly rely on periodic exchange of cartridges containing the therapeutic agent to be infused. When exchanging the cartridge in such a pump system, a temporary interruption of the otherwise uninterrupted flow of therapeutic agent into the body of the patient may ensue. In such a case, the phase of administration prior to cartridge replacement and the phase of administration following cartridge replacement would still be considered within the meaning of the pharmaceutical means and methods of the invention together make up one "uninterrupted administration" of such therapeutic agent.

The continuous or uninterrupted administration of the multispecific antibody constructs of the invention may be intravenous or subcutaneous by way of a fluid delivery device or small pump system including a fluid driving mechanism for driving fluid out of a reservoir and an actuating mechanism for actuating the driving mechanism. Pump systems for subcutaneous administration may include a needle or a cannula for penetrating the skin of a patient and delivering the suitable composition into the patient's body. Said pump systems may be directly fixed or attached to the skin of the patient independently of a vein, artery or blood vessel, thereby allowing a direct contact between the pump system and the skin of the patient. The pump system can be attached to the skin of the patient for 24 hours up to several days. The pump system may be of small size with a reservoir for small volumes. As a non-limiting example, the volume of the reservoir for the suitable pharmaceutical composition to be administered can be between 0.1 and 50 ml.

The continuous administration may also be transdermal by way of a patch worn on the skin and replaced at intervals. One of skill in the art is aware of patch systems for drug delivery suitable for this purpose. It is of note that transdermal administration is especially amenable to uninterrupted administration, as exchange of a first exhausted patch can advantageously be accomplished simultaneously with the placement of a new, second patch, for example on the surface of the skin immediately adjacent to the first exhausted patch and immediately prior to removal of the first exhausted patch. Issues of flow interruption or power cell failure do not arise.

If the pharmaceutical composition has been lyophilized, the lyophilized material is first reconstituted in an appropriate liquid prior to administration. The lyophilized material may be reconstituted in, e.g., bacteriostatic water for injection (BWFI), physiological saline, phosphate buffered saline (PBS), or the same formulation the protein had been in prior to lyophilization.

The compositions of the present invention can be administered to the subject at a suitable dose which can be determined e.g. by dose escalating studies by administration of increasing doses of the multispecific antibody construct of the invention exhibiting cross-species specificity described herein to non-chimpanzee primates, for instance macaques. As set forth above, the multispecific antibody construct of the invention exhibiting cross-species specificity described herein can be advantageously used in identical form in preclinical testing in non-chimpanzee primates and as drug in humans. The dosage regimen will be determined by the attending physician and clinical factors. As is well known in the medical arts, dosages for any one patient depend upon many factors, including the patient's size, body surface area, age, the particular compound to be administered, sex, time and route of administration, general health, and other drugs being administered concurrently.

The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. Amounts or doses effective for this use will depend on the condition to be treated (the indication), the delivered multispecific antibody construct, the therapeutic context and objectives, the severity of the disease, prior therapy, the patient's clinical history and response to the therapeutic agent, the route of administration, the size (body weight, body surface or organ size) and/or condition (the age and general health) of the patient, and the general state of the patient's own immune system. The proper dose can be adjusted according to the judgment of the attending physician such that it can be administered to the patient once or over a series of administrations, and in order to obtain the optimal therapeutic effect.

A therapeutic effective amount of an multispecific antibody construct of the invention preferably results in a decrease in severity of disease symptoms, an increase in frequency or duration of disease symptom-free periods or a prevention of impairment or disability due to the disease affliction. For treating MSLN-expressing tumors, a therapeutically effective amount of the multispecific antibody construct of the invention, e.g. an anti-MSLN/anti-CD40 multispecific antibody construct, preferably inhibits cell growth or tumor growth by at least about 20%, at least about 40%, at least about 50%, at least about 60%, at least about 70%, at least about 80%, or at least about 90% relative to untreated patients. The ability of a compound to inhibit tumor growth may be evaluated in an animal model predictive of efficacy in human tumors.

The pharmaceutical composition can be administered as a sole therapeutic or in combination with additional therapies such as anti-cancer therapies as needed, e.g. other proteinaceous and non-proteinaceous drugs. These drugs may be administered simultaneously with the composition comprising the multispecific antibody construct of the invention as defined herein or separately before or after administration of said multispecific antibody construct in timely defined intervals and doses.

The term "effective and non-toxic dose" as used herein refers to a tolerable dose of an inventive multispecific antibody construct which is high enough to cause depletion of pathologic cells, tumor elimination, tumor shrinkage or stabilization of disease without or essentially without major toxic effects. Such effective and non-toxic doses may be determined e.g. by dose escalation studies described in the art and should be below the dose inducing severe adverse side events (dose limiting toxicity, DLT).

The term "toxicity" as used herein refers to the toxic effects of a drug manifested in adverse events or severe adverse events. These side events might refer to a lack of tolerability of the drug in general and/or a lack of local tolerance after administration. Toxicity could also include teratogenic or carcinogenic effects caused by the drug.

The term "safety", "in vivo safety" or "tolerability" as used herein defines the administration of a drug without inducing severe adverse events directly after administration (local tolerance) and during a longer period of application of the drug. "Safety", "in vivo safety" or "tolerability" can be evaluated e.g. at regular intervals during the treatment and follow-up period. Measurements include clinical evaluation, e.g. organ manifestations, and screening of laboratory abnormalities. Clinical evaluation may be carried out and deviations to normal findings recorded/coded according to NCI-CTC and/or MedDRA standards. Organ manifestations may include criteria such as allergy/immunology, blood/bone marrow, cardiac arrhythmia, coagulation and the like, as set forth e.g. in the Common Terminology Criteria for adverse events v3.0 (CTCAE). Laboratory parameters which may be tested include for instance hematology, clinical chemistry, coagulation profile and urine analysis and examination of other body fluids such as serum, plasma, lymphoid or spinal fluid, liquor and the like. Safety can thus be assessed e.g. by physical examination, imaging techniques (i.e. ultrasound, x-ray, CT scans, Magnetic Resonance Imaging (MRI), other measures with technical devices (i.e. electrocardiogram), vital signs, by measuring laboratory parameters and recording adverse events. For example, adverse events in non-chimpanzee primates in the uses and methods according to the invention may be examined by histopathological and/or histochemical methods. The above terms are also referred to e.g. in the Preclinical safety evaluation of biotechnology-derived pharmaceuticals S6; ICH Harmonised Tripartite Guideline; ICH Steering Committee meeting on Jul. 16, 1997.

In a further embodiment, the invention provides a kit comprising an multispecific antibody construct of the invention, an multispecific antibody construct produced according to the process of the invention, a polynucleotide of the invention, a vector of the invention, and/or a host cell of the invention.

In the context of the present invention, the term "kit" means two or more components—one of which corresponding to the multispecific antibody construct, the pharmaceutical composition, the vector or the host cell of the invention—packaged together in a container, recipient or otherwise. A kit can hence be described as a set of products and/or utensils that are sufficient to achieve a certain goal, which can be marketed as a single unit.

The kit may comprise one or more recipients (such as vials, ampoules, containers, syringes, bottles, bags) of any appropriate shape, size and material (preferably waterproof, e.g. plastic or glass) containing the multispecific antibody construct or the pharmaceutical composition of the present invention in an appropriate dosage for administration (see above). The kit may additionally contain directions for use (e.g. in the form of a leaflet or instruction manual), means for administering the multispecific antibody construct of the present invention such as a syringe, pump, infuser or the like, means for reconstituting the multispecific antibody construct of the invention and/or means for diluting the multispecific antibody construct of the invention.

The invention also provides kits for a single-dose administration unit. The kit of the invention may also contain a first recipient comprising a dried/lyophilized multispecific antibody construct and a second recipient comprising an aqueous formulation. In certain embodiments of this invention, kits containing single-chambered and multi-chambered prefilled syringes (e.g., liquid syringes and lyosyringes) are provided.

Examples

Generation and Characterization of Anti-Mesothelin Antibodies
Anti-Mesothelin Antibody Generation.
Fully human antibodies to human mesothelin were generated as previously described (US20170029502A1) or by immunizing XENOMOUSE® transgenic mice (U.S. Pat. Nos. 6,114,598; 6,162,963; 6,833,268; 7,049,426; 7,064,244, which are incorporated herein by references in their entirety; Green et al., 1994, Nature Genetics 7:13-21; Mendez et al., 1997, Nature Genetics 15:146-156; Green and Jakobovits, 1998, J. Ex. Med, 188:483-495; Kellerman and Green, Current Opinion in Biotechnology 13, 593-597, 2002). Animals from the XMG4-K and XMG4-KL XENOMOUSE® strains were used for these immunizations. Animals were immunized with alternating soluble human mesothelin-His and cynomolgus mesothelin-His Animals with the highest antigen-specific serum native titers directed against human mesothelin and cynomolgus mesothelin were used for hybridoma generation (Kohler and Milstein, 1975). Pooled lymphocytes from spleen and/or draining lymph node (from each harvest) were dissociated from lymphoid tissue by grinding in a suitable medium (for example, Dulbecco's Modified Eagle Medium (DMEM); Invitrogen, Carlsbad, CA). B cells were selected and/or expanded using standard methods, and fused with a suitable fusion partner using techniques that were known in the art. Hybridoma supernatants with binding to human mesothelin and cynomolgus mesothelin were then selected for further characterization.

Sequencing of Anti-Mesothelin Antibodies.
For XENOMOUSE®-derived antibodies, RNA (total or mRNA) was purified from wells containing the anti-mesothelin antibody-producing hybridoma cells using a Qiagen RNeasy mini or the Invitrogen mRNA catcher plus kit. Purified RNA was used to amplify the antibody heavy and light chain variable region (V) genes using cDNA synthesis via reverse transcription, followed by a polymerase chain reaction (RT-PCR). The fully human antibody gamma heavy chain was obtained using the Qiagen One Step Reverse Transcriptase PCR kit (Qiagen). The fully human kappa light chain was obtained using the Qiagen One Step Reverse Transcriptase PCR kit (Qiagen). Amino acid sequences were deduced from the corresponding nucleic acid sequences bioinformatically. The derived amino acid sequences were then analyzed to determine the germline sequence origin of the antibodies and to identify deviations from the germline sequence. The amino acid sequences corresponding to complementary determining regions (CDRs) of the sequenced antibodies were aligned and these alignments were used to group the clones by similarity.

Antibody Production.
Selected and sequenced anti-mesothelin antibody heavy and light chains were subcloned into mammalian expression vectors and individual antibodies were produced and purified. All antibodies were reformatted with human IgG1 SEFL2 (REF) heavy chain sequences.

Binding of Antibodies to Human and Cynomolgus Monkey Mesothelin.
Binding of anti-mesothelin antibodies to human mesothelin was confirmed by flow cytometry on CHO cells engineered to express human mesothelin (huMSLN-CHO). Human MSLN-transfected CHO cells were incubated with various concentrations of purified anti-mesothelin antibodies, washed, and labeled with a fluorescent-conjugated secondary antibody specific for human IgG. Cells were then analyzed by flow cytometry. The percentage of fluorescent positive cells was plotted against antibody concentration (FIG. 1) and the EC50 was determined using Prism GraphPad software (Table 1). The binding affinity of anti-human mesothelin antibodies to soluble forms of recombinant human and cynomolgus monkey (cyno) mesothelin was also measured by Octet assay (Table 1), quantifying association rate (Kon), disassociation rate (Kdis), and equilibrium binding constant (KD). These data demonstrated binding of all anti-MSLN antibodies to both human and cynomolgus monkey mesothelin.

TABLE 1

| | | | On Cell Binding | Octet Binding human MSLN | | | Octet Binding Cyno MSLN | | |
|---|---|---|---|---|---|---|---|---|---|
| PL# | BioReg ID | Clone | human MSLN EC50 (uM) | Kon (1/Ms) | Kdis (1/s) | KD (nM) | Kon (1/Ms) | Kdis (1/s) | KD (nM) |
| PL-55235 | 4553 | 6F4 | 0.01 | 4.50E+05 | 8.77E−05 | 0.19 | 3.35E+05 | 1.75E−03 | 5.2 |
| PL-55238 | 4559 | 7G11 | 0.003 | 5.48E+05 | 1.85E−04 | 0.34 | 2.94E+05 | 1.88E−03 | 6.4 |
| PL-54455 | 3966 | 4H6 | 0.002 | 3.58E+05 | 5.16E−05 | 0.14 | 3.92E+05 | 7.64E−04 | 1.9 |
| PL-54456 | 3967 | 4G12 | 0.001 | 8.42E+04 | 1.62E−05 | 0.19 | 1.24E+05 | 5.60E−04 | 4.5 |

Generation and Characterization of Anti-CD40 Agonist Antibodies

Anti-CD40 Antibody Generation.

Fully human antibodies to human CD40 were generated by immunizing XENOMOUSE® transgenic mice (U.S. Pat. Nos. 6,114,598; 6,162,963; 6,833,268; 7,049,426; 7,064,244, which are incorporated herein by references in their entirety; Green et al., 1994, *Nature Genetics* 7:13-21; Mendez et al., 1997, *Nature Genetics* 15:146-156; Green and Jakobovitis, 1998, *J. Ex. Med*, 188:483-495; Kellerman and Green, *Current Opinion in Biotechnology* 13, 593-597, 2002) Animals from the XMG4-K and XMG4-KL XENOMOUSE® strains were used for these immunizations. Multiple immunogens and routes of immunization were used to generate anti-human CD40 immune responses. For soluble recombinant protein immunizations, mice were immunized with alternating soluble human CD40-Fc and cynomolgus CD40-Fc. For cell-based immunizations, CHO-S cells were transiently transfected with either wild type human CD40 or cynomolgus CD40 as a source of immunogen. Animals were immunized with either of these transiently transfected CHO cells Animals with the highest antigen-specific serum native titers directed against human CD40 and cynomolgus CD40 were used for hybridoma generation (Kohler and Milstein, 1975). Pooled lymphocytes from spleen and/or draining lymph node (from each harvest) were dissociated from lymphoid tissue by grinding in a suitable medium (for example, Dulbecco's Modified Eagle Medium (DMEM); Invitrogen, Carlsbad, CA). B cells were selected and/or expanded using standard methods and fused with a suitable fusion partner using techniques that were known in the art. Hybridoma supernatants with binding to human and cynomolgus monkey CD40 were identified.

Antibody Production.

Select hybridoma supernatants showing binding to human and cynomolgus monkey CD40 were used to produce purified anti-CD40 antibodies using techniques that were known to the art (Table 2).

TABLE 2

| Anti-CD40 antibodies | | | |
|---|---|---|---|
| Antibody | HC Sequence | | IgG |
| ID | VH Germline | HC CDR3 | Subclass |
| 29H10 | VH1\|1-02/D5\|5-18\|RF1/JH5 | ERISMVRGVGHNWFAP (SEQ ID NO: 150) | IgG4 |
| 4G7 | VH1\|1-02/D3\|3-16\|RF3/JH4 | EKITMTGIYFDY (SEQ ID NO: 198) | IgG4 |
| 33H6 | VH1\|1-02/D1\|1-7\|RF3/JH6 | EKPRYFDSFYYYLMDV (SEQ ID NO: 210) | IgG4 |
| 35F11 | VH3\|3-33/D5\|5-24\|RF3/JH4 | DGRNVYFDN (SEQ ID NO: 186) | IgG4 |
| 30A12 | VH3\|3-23/D6\|6-13\|RF1/JH4 | GYSNSWWYFDY (SEQ ID NO: 180) | IgG4 |
| 36F3 | VH6\|6-01/D6\|6-13\|RF2/JH4 | GAAPFDY (SEQ ID NO: 144) | IgG4 |
| 39C2 | VH1\|1-02/D1\|1-1\|RF1/JH4 | ERCRTTNCYLDY (SEQ ID NO: 192) | IgG4 |
| 33H9 | VH3\|3-33/D7\|7-27\|RF1/JH6 | GGGHWNYEGHYYGMDV (SEQ ID NO: 138) | IgG4 |
| 37A6 | VH3\|3-11/D6\|6-6\|RF2/JH4 | DLAAGATGGLDC (SEQ ID NO: 174) | IgG4 |

Anti-CD40 Antibody Binding to Human and Cynomolgus Monkey CD40.

The binding affinity of anti-human CD40 antibodies to human and cynomolgus monkey CD40 was measured by Octet assay (Table 3), quantifying association rate (Kon), disassociation rate (Kdis), and equilibrium binding constant (KD). Cross-reactivity of anti-CD40 antibodies to related TNF receptor superfamily (TNFRSF) members was evaluated by expressing human TNFR1, TNFR2, TNFR10, or TNFR14 on HEK293 cells by transient transfection of expression vectors encoding these genes. Binding of indicated anti-human CD40 antibody to these transfected cells was determined by flow cytometry. Evaluating geometric mean florescent intensity relative to control cells demonstrated minimal binding of anti-CD40 to other TNFRSF members (Table 4). Cross-reactivity of anti-CD40 antibodies to cynomolgus monkey and mouse CD40 was evaluated by expressing cynomolgus monkey or mouse CD40 on HEK293 cells by by transient transfection of expression vectors encoding these genes. Binding of indicated anti-human CD40 antibody to cells overexpressing cynomolgus monkey and mouse CD40 was determined by flow cytometry. Evaluating geometric mean florescent intensity relative to control cells demonstrated robust binding of anti-CD40 to cynomolgus monkey (cyno) CD40, but no binding to mouse CD40 (Table 5). Taken together these data demonstrate strong and equivalent binding of anti-CD40 antibodies to human and cynomolgus monkey CD40, but minimal binding to related TNFRSF members or mouse CD40.

TABLE 3

Binding affinity of anti-CD40 antibodies to human and cyno CD40

| | Human CD40 | | | Cyno CD40 | | |
| --- | --- | --- | --- | --- | --- | --- |
| Antibody ID | kon (1/Ms) | kdis (1/s) | KD (nM) | kon (1/Ms) | kdis (1/s) | KD (nM) |
| 29H10 | 3.98E+05 | 1.64E−04 | 0.41 | 6.12E+05 | 2.44E−04 | 0.39 |
| 4G7 | 1.23E+06 | 1.08E−03 | 0.88 | 1.13E+06 | 1.93E−03 | 1.72 |
| 33H6 | 5.09E+05 | 6.80E−04 | 1.34 | 5.56E+05 | 5.77E−04 | 1.04 |
| 35F11 | 5.56E+05 | 3.10E−04 | 0.55 | 5.06E+05 | 3.14E−04 | 0.62 |
| 30A12 | 5.33E+05 | 3.68E−04 | 0.69 | 5.44E+05 | 3.06E−04 | 0.56 |
| 36F3 | 6.45E+04 | 4.43E−04 | 6.87 | 5.22E+04 | 2.10E−04 | 4.02 |
| 39C2 | 5.99E+05 | 6.14E−04 | 1.02 | 5.18E+05 | 3.76E−04 | 0.73 |
| 33H9 | 4.07E+05 | 2.38E−04 | 0.58 | 4.02E+05 | 1.68E−04 | 4.17 |
| 37A6 | 6.12E+05 | 6.72E−04 | 1.10 | 5.31E+05 | 3.87E−04 | 0.73 |

TABLE 4

Absence of anti-CD40 antibody binding to related TNF receptor superfamily members (fold over control values)

| Antibody ID | TNFR1 | TNFR2 | TNFR10 | TNFR14 |
| --- | --- | --- | --- | --- |
| 29H10 | 0.98 | 0.88 | 0.89 | 0.84 |
| 4G7 | 0.97 | 0.90 | 0.87 | 0.89 |
| 33H6 | 1.00 | 0.81 | 0.77 | 0.80 |
| 35F11 | 1.00 | 0.85 | 0.73 | 0.74 |
| 30A12 | 1.07 | 0.89 | 0.91 | 0.96 |
| 36F3 | 0.99 | 0.92 | 0.86 | 0.88 |
| 39C2 | 1.00 | 0.90 | 0.86 | 0.89 |
| 33H9 | 1.03 | 0.93 | 0.89 | 0.88 |
| 37A6 | 0.99 | 0.87 | 0.88 | 0.87 |

TABLE 5

Species cross-reactivity of anti-CD40 antibodies to cyno and mouse CD40 (fold over control values)

| Antibody ID | Cyno | Mouse |
| --- | --- | --- |
| 29H10 | 71 | 0.8 |
| 4G7 | 57 | 0.9 |
| 33H6 | 74 | 0.9 |
| 35F11 | 76 | 0.8 |
| 30A12 | 71 | 1.3 |
| 36F3 | 82 | 0.9 |
| 39C2 | 87 | 0.9 |
| 33H9 | 73 | 0.9 |
| 37A6 | 92 | 0.9 |

Cross-Linking-Dependent Activation of CD40 by Anti-CD40 Antibodies.

Figure 2A:
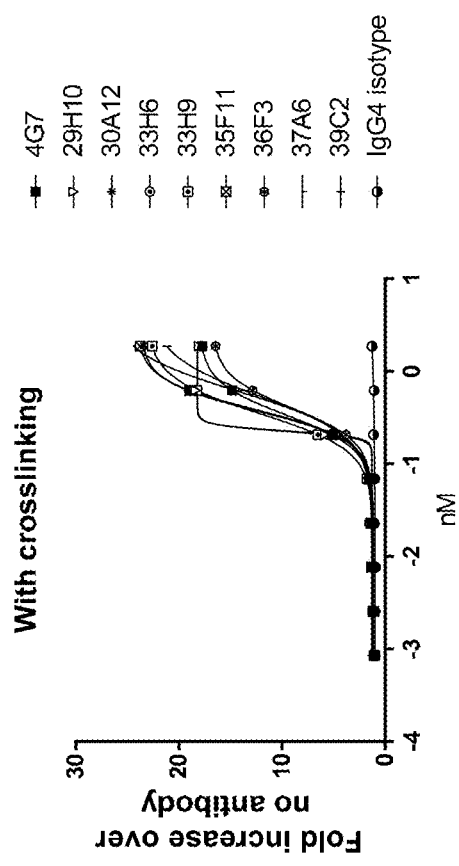
FIGS. 2A-2B depict Activity of anti-CD40 antibodies with and without crosslinking in human B cell assay.
Figure 2B:
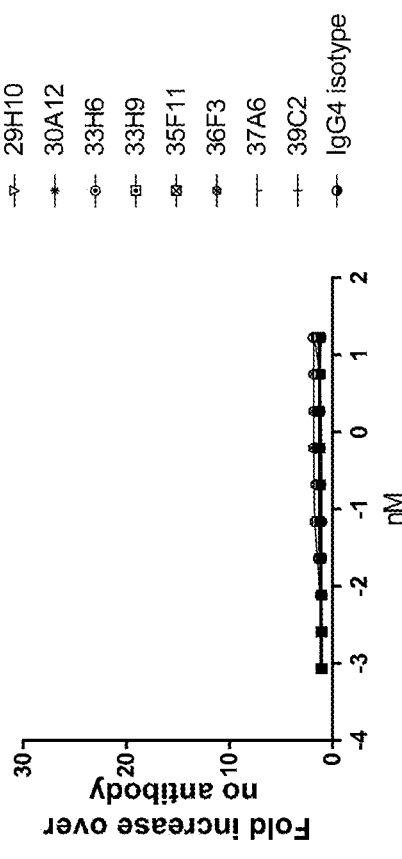

Stimulation of the CD40 receptor on human B cells results in activation ad proliferation. Purified primary human B cells were seeded into 384-well assay plates and treated with IL-4/IL-21 as co-mitogens, varying concentrations of anti-CD40 antibodies, and the presence (FIG. 2A) or absence (FIG. 2B) of protein G. A single molecule of Protein G is capable of binding multiple IgG molecules and can thus cross-link antibodies in solution. Cells were incubated for 5 days and cell proliferation was examined using CellTiter-Glo. An irrelevant IgG4 isotype antibody was included as a negative control as all anti-CD40 antibodies examined were IgG4. EC50 and percent maximum activity were calculated (Table 6). All anti-CD40 antibodies induced robust proliferation of B cells in the presence of protein G but had minimal activity in the absence of protein G, indicating that anti-CD40 antibody binding to CD40 alone was insufficient to stimulate CD40 and that additional cross-linking of the antibodies was required.

TABLE 6

Activity of anti-CD40 antibodies with and without crosslinking in human B cell functional assay

| Antibody ID | No Crosslinking EC50 (nM) | No Crosslinking Max Fold Change | With Crosslinking EC50 (nM) | With Crosslinking Max Fold Change |
| --- | --- | --- | --- | --- |
| 29H10 | >16.7 | 1.35 | 0.235 | 18.22 |
| 4G7 | >16.7 | 1.19 | 0.430 | 18.05 |
| 33H6 | >16.7 | 1.21 | 0.237 | 18.24 |
| 35F11 | >16.7 | 1.33 | 0.371 | 24.16 |
| 30A12 | >16.7 | 1.45 | 0.362 | 23.78 |
| 36F3 | >16.7 | 1.83 | 0.558 | 16.85 |
| 39C2 | >16.7 | 1.24 | 0.529 | 23.01 |
| 33H9 | >16.7 | 1.35 | 0.344 | 23.17 |
| 37A6 | >16.7 | 1.19 | 0.504 | 27.09 |

Effect of Anti-CD40 Antibodies on Binding to Human CD40 Ligand to Human CD40.

To evaluate the ability of the anti-CD40 antibodies to block CD40 ligand interactions with CD40, a flow cytometry-based ligand binding assay was performed to measure the binding of florescent-labeled soluble human CD40L to human CD40 over-expressed on 293T cells by transient transfection with an expression vector encoding this gene. Percent ligand binding inhibition was calculated as [(CD40L binding gMFI in the absence of anti-CD40)-(CD40L binding gMFI in the presence of anti-CD40)]/(CD40L binding gMFI in the absence of anti-CD40). gMFI: geometric mean fluorescent intensity. All anti-CD40 antibodies show minimal effects on the ability of CD40L to bind to the CD40 receptor (Table 7).

TABLE 7

Anti-CD40 antibodies do not block CD40-CD40L interactions

| Antibody ID | Ligand Binding Inhibition (%) | | | | Ligand Blocker |
|---|---|---|---|---|---|
| | 20 ug/ml | 10 ug/ml | 5 ug/ml | 2.5 ug/ml | |
| 29H10 | −7% | 1% | −8% | −11% | No |
| 4G7 | 3% | 14% | 24% | 21% | No |
| 33H6 | 7% | 11% | 4% | −8% | No |
| 35F11 | 8% | 51% | −5% | −15% | No |
| 30A12 | −3% | −8% | −15% | −16% | No |
| 36F3 | 1% | 14% | 10% | 1% | No |
| 39C2 | 2% | 3% | −6% | 7% | No |
| 33H9 | 1% | 3% | 9% | −3% | No |
| 37A6 | 12% | 6% | 2% | −19% | No |

Effects of Anti-Human CD40 Antibody on CD40L-Induced B Cell Activation.

Some antibodies specific for TNFRSF members have been shown to potentiate activation of the receptor by its normal ligand, potentially by clustering the receptor and decreasing the threshold for ligand-induced activation. To evaluate the ability of the anti-CD40 antibodies to potentiate CD40 ligand activity, purified primary human B cells were treated with various concentrations of recombinant human CD40L in the presence or absence of 1 ug/ml of the indicated CD40 antibody. Cells were incubated for 5 days and cell proliferation was examined using CellTiter-Glo. None of the anti-CD40 antibodies induced a significant change in the EC50 of CD40 ligand to stimulate proliferation of human B cells (Table 8).

TABLE 8

Anti-CD40 antibodies do not potentiate activity of CD40L

| Antibody ID | CD40L EC50 (ug/ml) |
|---|---|
| No Antibody | 0.001085 |
| 29H10 | 0.000715 |
| 4G7 | 0.00104 |
| 33H6 | 0.001135 |
| 35F11 | 0.006655 |
| 30A12 | 0.00081 |
| 36F3 | 0.012975 |
| 39C2 | 0.000985 |
| 33H9 | No Activity |
| 37A6 | 0.00139 |

Sequencing of Anti-CD40 Antibodies.

RNA (total or mRNA) was purified from wells containing the anti-mesothelin antibody-producing hybridoma cells using a Qiagen RNeasy mini or the Invitrogen mRNA catcher plus kit. Purified RNA was used to amplify the antibody heavy and light chain variable region (V) genes using cDNA synthesis via reverse transcription, followed by a polymerase chain reaction (RT-PCR). The fully human antibody gamma heavy chain was obtained using the Qiagen One Step Reverse Transcriptase PCR kit (Qiagen). The fully human kappa light chain was obtained using the Qiagen One Step Reverse Transcriptase PCR kit (Qiagen) Amino acid sequences were deduced from the corresponding nucleic acid sequences bioinformatically. The derived amino acid sequences were then analyzed to determine the germline sequence origin of the antibodies and to identify deviations from the germline sequence. The amino acid sequences corresponding to complementary determining regions (CDRs) of the sequenced antibodies were aligned and these alignments were used to group the clones by similarity.

Optimization of Anti-CD40 Antibody Sequences.

Engineering of select anti-CD40 antibodies was performed to remove potential sequence liabilities in the antibody heavy and light chain variable regions by standard recombinant DNA techniques. These antibodies were produced by over-expression in cell lines and purified using techniques that were known in the art. Purified antibodies were then evaluated in a human B cell proliferation assay with and without protein G cross-linking, as described above. EC50 and percent maximum activity were calculated (Table 9), showing that many of the engineered antibody variants maintained similar cross-linking dependent agonist activity as their parental antibody sequence.

TABLE 9

Functional activity of engineered variants of anti-CD40 antibodies

| Antibody Name | Antibody ID | No Crosslinking EC50 (nM) | No Crosslinking % Max Activity | With Crosslinking EC50 (nM) | With Crosslinking % Max Activity |
|---|---|---|---|---|---|
| 29H10 | 4877-1 | >16.7 | 4.4 | 0.37 | 65.9 |
| 30A12 | 4878-1 | >16.7 | 8.6 | 0.40 | 89.1 |
| 30A12.001 | 4894-1 | >5.93 | 12.2 | 0.08 | 87.2 |
| 30A12.002 | 4879-1 | >16.7 | 19.0 | 0.36 | 89.2 |
| 30A12.003 | 4880-1 | >16.7 | 1.2 | 0.41 | 83.3 |
| 33H6 | 4883-1 | >16.7 | 6.5 | 0.26 | 73.4 |
| 33H6.001 | 4884-1 | >16.7 | 10.8 | 0.46 | 92.7 |
| 33H6.002 | 4885-1 | >16.7 | 11.5 | 0.40 | 81.2 |
| 33H6.003 | 4895-1 | >6.22 | 6.5 | 0.43 | 61.4 |
| 33H6.004 | 4886-1 | >16.7 | 20.9 | 0.44 | 73.5 |
| 33H9 | 4897-1 | >13.4 | 2.3 | 0.19 | 88.9 |
| 35F11 | 4868-1 | >16.7 | 4.4 | 0.30 | 119.7 |
| 35F11.001 | 5052-2 | >16.7 | 12.5 | 0.85 | 96.5 |
| 35F11.002 | 5053-2 | >16.7 | 6.4 | 0.77 | 84.2 |
| 35F11.003 | 5054-2 | >16.7 | 10.5 | 0.60 | 74.6 |
| 35F11.004 | 5055-2 | >16.7 | 10.0 | 0.90 | 83.7 |
| 35F11.005 | 5056-2 | >16.7 | 5.4 | 0.68 | 77.8 |
| 35F11.006 | 5057-2 | >16.7 | 4.8 | 0.49 | 109.0 |

TABLE 9-continued

Functional activity of engineered variants of anti-CD40 antibodies

| Antibody Name | Antibody ID | No Crosslinking EC50 (nM) | No Crosslinking % Max Activity | With Crosslinking EC50 (nM) | With Crosslinking % Max Activity |
|---|---|---|---|---|---|
| 36F3 | 4891-1 | >16.7 | 8.2 | 0.30 | 81.9 |
| 37A6 | 4865-1 | >16.7 | 0.4 | 0.30 | 80.9 |
| 37A6.001 | 4866-1 | >16.7 | −0.2 | 0.32 | 86.7 |
| 37A6.002 | 4892-1 | >5.87 | −1.9 | 0.11 | 87.3 |
| 37A6.003 | 4867-1 | >16.7 | −1.1 | 0.21 | 73.0 |
| 39C2 | 4887-1 | >16.7 | 6.1 | 0.21 | 76.6 |
| 39C2.001 | 4888-1 | >16.7 | 1.2 | >16.7 | 2.2 |
| 39C2.002 | 4889-1 | >16.7 | 21.9 | 4.36 | 86.5 |
| 39C2.003 | 4890-1 | >16.7 | 4.6 | >16.7 | 1.7 |
| 4G7 | 4869-1 | >16.7 | 6.0 | 0.50 | 70.5 |
| 4G7.001 | 4893-1 | >5.99 | 2.7 | 0.83 | 80.5 |
| 4G7.002 | 4870-1 | >16.7 | 2.1 | 0.62 | 72.2 |
| 4G7.003 | 4871-1 | >16.7 | 3.9 | 0.77 | 89.1 |
| 4G7.004 | 4872-1 | >16.7 | 2.3 | 1.01 | 96.8 |

Generation and Characterization of Mesothelin-Targeted CD40 Agonist Bivalent Bispecific Antibodies Bispecific Antibody Production.

Figure 3B:
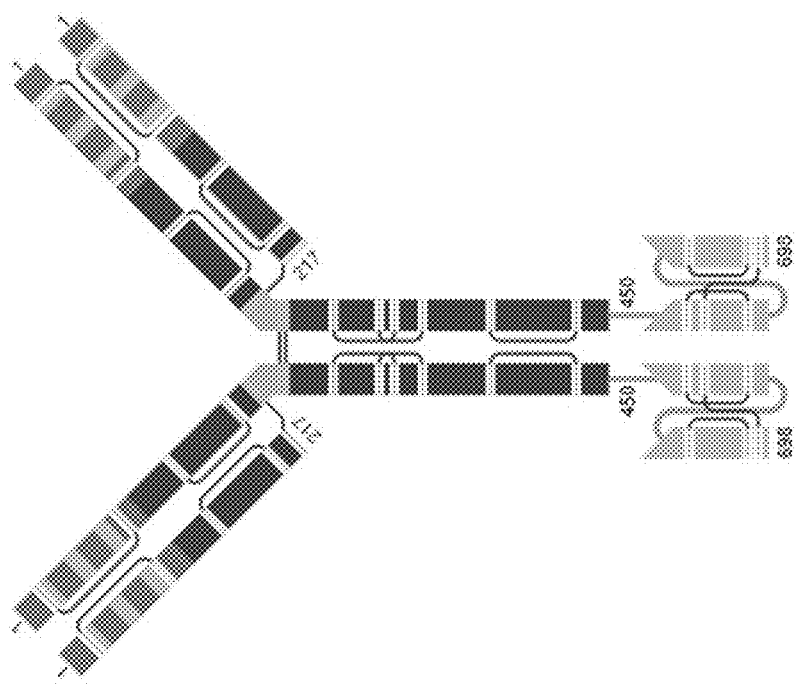
FIGS. 3A-3B depict Bivalent bispecific antibody formats.
Figure 3A:
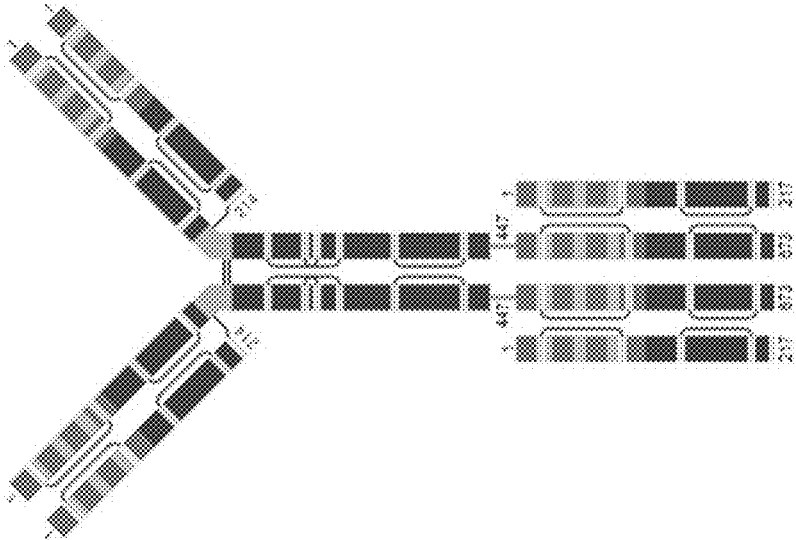

In order to generate a mesothelin-dependent CD40 agonist, bivalent bispecific antibodies capable of binding to both human mesothelin and human CD40 were generated in either an IgG-Fab format (FIG. 3A) or an IgG-scFv format (FIG. 3B) using the variable region binding domains of the anti-mesothelin and anti-CD40 antibodies described above.

Generation and Evaluation of Mesothelin×CD40 Bispecific Agonist Antibodies in the IgG-Fab Format.

A panel of mesothelin×CD40 bispecific antibodies were generated in the IgG-Fab format (Table 10) and evaluated for binding to soluble forms of human and cynomolgus monkey CD40 and human and cynomolgus monkey mesothelin using the Octet assay (Table 11). Association rate ($K_{on}$), disassociation rate ($K_{dis}$), and equilibrium binding constant ($K_D$) were calculated. The majority of bispecific antibodies showed high affinity binding to both human and cynomolgus monkey CD40 and mesothelin. These bispecific antibodies were next evaluated for their ability to induce mesothelin-dependent activation of human B cells. CHO cells expressing human mesothelin were seeded into a 96 well plate. The next day varying concentrations of the mesothelin×CD40 IgG-Fab antibodies were added to the wells along with purified human B cells and the plates were incubated for an additional 48 hours. Upregulation of CD86, a marker of CD40-mediated B cell activation, was quantified on B cells by flow cytometry. EC50 values for CD86 upregulation were calculated and demonstrate that the majority of mesothelin×CD40 IgG-Fab bispecific antibodies were able to B cell activation in the presence of CHO cells expressing human mesothelin (Table 12).

TABLE 10

Anti-CD40xMSLN IgG-Fab molecules

| Antibody ID | IgG (MSLN) | Fab (CD40) | IgG (CD40) | Fab (MSLN) |
|---|---|---|---|---|
| 13468-1 | 4G12 | 30A12 | | |
| 5966-1 | 4H6 | 37A6 | | |
| 5978-1 | 7G11 | 33H9 | | |
| 13473-1 | | | 30A12 | 4G12 |
| 13474-1 | | | 35F11 | 4G12 |
| 13469-1 | 4G12 | 35F11 | | |
| 5967-1 | 6F4 | 29H10 | | |
| 6057-1 | 7G11 | 37A6 | | |
| 5991-1 | | | 30A12 | 6F4 |
| 6003-1 | | | 35F11 | 6F4 |
| 13470-1 | 4G12 | 37A6 | | |
| 5968-1 | 6F4 | 30A12 | | |
| 6058-1 | 7G11 | 39C2 | | |
| 5992-1 | | | 30A12 | 7G11 |
| 13475-1 | | | 36F3 | 4G12 |
| 13471-1 | 4G12 | 39C2 | | |
| 5970-1 | 6F4 | 33H9 | | |
| 5982-1 | | | 4G7 | 4H6 |
| 6007-1 | | | 36F3 | 6F4 |
| 5960-1 | 4H6 | 29H10 | | |
| 5972-1 | 6F4 | 36F3 | | |
| 5983-1 | | | 4G7 | 6F4 |
| 5995-1 | | | 33H6 | 6F4 |
| 5946-1 | | | 37A6 | 4H6 |
| 5961-1 | 4H6 | 30A12 | | |
| 5973-1 | 6F4 | 37A6 | | |
| 13472-1 | | | 29H10 | 4G12 |
| 5998-1 | | | 33H9 | 4H6 |
| 5947-1 | | | 37A6 | 7G11 |
| 5963-1 | 4H6 | 33H9 | | |
| 5975-1 | 7G11 | 29H10 | | |
| 5987-1 | | | 29H10 | 6F4 |
| 5999-1 | | | 33H9 | 6F4 |
| 5965-1 | 4H6 | 36F3 | | |
| 5976-1 | 7G11 | 30A12 | | |
| 5988-1 | | | 29H10 | 7G11 |
| 6000-1 | | | 33H9 | 7G11 |

TABLE 11

Anti-CD40xMSLN IgG-Fab molecule binding to human and cynomolgus monkey CD40 and mesothelin

| Antibody ID | huCD40(1-193) | | | cynoCD40(1-193) | | | huMSLN(296-598) | | | cynoMSLN(296-598) | | |
|---|---|---|---|---|---|---|---|---|---|---|---|---|
| | $K_D$ (nM) | $k_a$ ($M^{-1}s^{-1}$) | $k_d$ ($s^{-1}$) | $K_D$ (nM) | $k_a$ ($M^{-1}s^{-1}$) | $k_d$ ($s^{-1}$) | $K_D$ (nM) | $k_a$ ($M^{-1}s^{-1}$) | $k_d$ ($s^{-1}$) | $K_D$ (nM) | $k_a$ ($M^{-1}s^{-1}$) | $k_d$ ($s^{-1}$) |
| 5959-1 | 0.4 | 5.11E+05 | 2.14E−04 | 0.7 | 6.21E+05 | 4.28E−04 | <0.1 | 2.29E+05 | >1.00E−05 | 6.0 | 1.10E+05 | 6.58E−04 |
| 5960-1 | 0.4 | 4.20E+05 | 1.82E−04 | 0.5 | 3.55E+05 | 1.76E−04 | 0.2 | 7.98E+05 | 1.79E−04 | 2.5 | 3.66E+05 | 9.16E−04 |
| 5961-1 | 0.6 | 6.22E+05 | 3.42E−04 | 0.8 | 3.39E+05 | 2.66E−04 | <0.1 | 6.80E+05 | >1.00E−05 | 2.7 | 3.56E+05 | 9.58E−04 |
| 5963-1 | <0.1 | 8.85E+04 | >1.00E−05 | 0.8 | 1.47E+05 | 1.15E−04 | 0.2 | 8.46E+05 | 1.56E−04 | 2.9 | 3.10E+05 | 9.03E−04 |
| 5965-1 | 2.5 | 1.19E+05 | 2.97E−04 | 2.7 | 9.51E+04 | 2.55E−04 | 0.2 | 8.03E+05 | 1.40E−04 | 2.1 | 4.24E+05 | 8.96E−04 |
| 5966-1 | 0.7 | 5.84E+05 | 4.03E−04 | 0.9 | 4.20E+05 | 3.58E−04 | 0.2 | 8.78E+05 | 1.76E−04 | 2.5 | 3.78E+05 | 9.40E−04 |
| 5967-1 | 0.8 | 3.75E+05 | 2.86E−04 | <0.1 | 1.83E+05 | >1.00E−05 | 0.3 | 9.12E+05 | 2.89E−04 | 6.4 | 3.71E+05 | 2.36E−03 |
| 5968-1 | 0.4 | 6.50E+05 | 2.56E−04 | 0.7 | 5.98E+05 | 4.14E−04 | 0.3 | 1.03E+06 | 3.53E−04 | 5.1 | 5.56E+05 | 2.82E−03 |
| 5970-1 | 1.6 | 2.45E+05 | 3.95E−04 | 1.3 | 1.63E+05 | 2.08E−04 | 0.3 | 7.74E+05 | 2.58E−04 | 5.8 | 4.31E+05 | 2.48E−03 |
| 5972-1 | 4.0 | 1.34E+05 | 5.31E−04 | 1.7 | 8.06E+04 | 1.37E−04 | 0.5 | 5.68E+05 | 2.70E−04 | 4.6 | 4.54E+05 | 2.10E−03 |
| 5973-1 | 0.6 | 5.41E+05 | 3.25E−04 | 0.6 | 6.69E+05 | 4.04E−04 | 0.5 | 4.51E+05 | 2.23E−04 | 5.5 | 3.90E+05 | 2.13E−03 |
| 5975-1 | <0.2 | 4.41E+05 | >1.00E−05 | 0.8 | 5.33E+05 | 4.02E−04 | 0.8 | 4.20E+05 | 3.41E−04 | 6.6 | 3.39E+05 | 2.24E−03 |
| 5976-1 | 0.6 | 9.01E+05 | 5.25E−04 | 0.3 | 7.95E+05 | 2.32E−04 | 0.8 | 4.06E+05 | 3.30E−04 | 7.6 | 3.15E+05 | 2.40E−03 |
| 5978-1 | <0.3 | 7.77E+04 | >1.00E−05 | 1.0 | 1.30E+05 | 1.31E−04 | 0.8 | 3.90E+05 | 2.98E−04 | 8.5 | 2.76E+05 | 2.33E−03 |
| 6057-1 | 0.8 | 6.46E+05 | 4.97E−04 | 0.7 | 1.00E+06 | 7.04E−04 | 0.8 | 4.30E+05 | 3.65E−04 | 9.2 | 2.54E+05 | 2.33E−03 |
| 6058-1 | 0.6 | 9.27E+05 | 5.29E−04 | 1.0 | 6.01E+05 | 4.93E−04 | 0.8 | 3.81E+05 | 3.17E−04 | 6.8 | 3.42E+05 | 2.32E−03 |
| 5982-1 | 1.2 | 1.68E+06 | 1.98E−03 | 1.5 | 1.28E+06 | 1.89E−03 | <0.1 | 2.17E+05 | >1.00E−05 | 4.7 | 2.27E+05 | 1.06E−03 |
| 5983-1 | 1.7 | 1.12E+06 | 1.95E−03 | 1.5 | 1.43E+06 | 2.11E−03 | 1.0 | 2.63E+05 | 2.72E−04 | 12.3 | 3.42E+05 | 4.21E−03 |
| 5987-1 | 0.7 | 6.00E+05 | 4.23E−04 | 0.7 | 7.52E+05 | 5.26E−04 | 1.0 | 4.24E+05 | 4.39E−04 | 18.3 | 2.10E+05 | 3.83E−03 |
| 5988-1 | 0.3 | 1.66E+06 | 4.76E−04 | 0.2 | 2.90E+06 | 6.54E−04 | 2.5 | 1.44E+05 | 3.61E−04 | 29.4 | 7.72E+04 | 2.27E−03 |
| 5991-1 | 0.4 | 1.08E+06 | 4.67E−04 | 0.2 | 1.86E+06 | 4.23E−04 | 1.3 | 1.81E+05 | 2.42E−04 | 31.9 | 1.52E+05 | 4.83E−03 |
| 5992-1 | 0.3 | 1.34E+06 | 4.21E−04 | 0.3 | 1.98E+06 | 5.32E−04 | 1.9 | 1.44E+05 | 2.68E−04 | 25.5 | 1.05E+05 | 2.67E−03 |
| 5995-1 | 0.4 | 1.06E+06 | 3.80E−04 | 0.2 | 1.80E+06 | 3.77E−04 | 0.9 | 2.81E+05 | 2.47E−04 | 26.2 | 1.12E+05 | 2.93E−03 |
| 5998-1 | 0.3 | 7.12E+05 | 2.26E−04 | 0.2 | 1.07E+06 | 2.04E−04 | 0.6 | 6.20E+05 | 3.81E−04 | 15.6 | 6.72E+04 | 1.05E−03 |
| 5999-1 | 0.2 | 5.80E+05 | 1.11E−04 | 0.6 | 3.95E+05 | 2.44E−04 | 1.0 | 3.38E+05 | 3.22E−04 | 30.9 | 1.26E+05 | 3.89E−03 |
| 6000-1 | 0.3 | 6.59E+05 | 1.83E−04 | 0.5 | 4.10E+05 | 1.99E−04 | 1.1 | 3.64E+05 | 3.94E−04 | 40.0 | 5.37E+04 | 2.15E−03 |
| 6003-1 | 0.7 | 1.14E+06 | 8.03E−04 | 0.5 | 1.58E+06 | 7.73E−04 | 1.2 | 2.45E+05 | 2.95E−04 | 62.6 | 8.58E+04 | 5.37E−03 |
| 6007-1 | 3.3 | 1.41E+05 | 4.63E−04 | 2.7 | 2.44E+05 | 6.62E−04 | 0.8 | 4.92E+05 | 4.09E−04 | 40.2 | 1.30E+05 | 5.23E−03 |
| 5946-1 | 1.0 | 5.89E+05 | 6.01E−04 | 0.9 | 5.91E+05 | 5.20E−04 | 0.9 | 4.06E+05 | 3.61E−04 | 3.1 | 2.64E+05 | 8.25E−04 |
| 5947-1 | 1.1 | 5.14E+05 | 5.72E−04 | 1.1 | 5.77E+05 | 6.17E−04 | 1.2 | 2.77E+05 | 3.46E−04 | 27.3 | 8.60E+04 | 2.35E−03 |

TABLE 12

Anti-CD40xMSLN IgG-Fab molecule functional activity on human B cells in the presence of CHO cells expressing human mesothelin

| Antibody ID | EC50 (nM) |
|---|---|
| 13468-1 | 0.007 |
| 5966-1 | 0.008 |
| 5978-1 | 0.033 |
| 13473-1 | 0.007 |
| 13474-1 | 0.009 |
| 13469-1 | 0.011 |
| 5967-1 | 0.005 |
| 6057-1 | 0.018 |
| 5991-1 | 0.004 |
| 6003-1 | 0.007 |
| 13470-1 | 0.008 |
| 5968-1 | 0.004 |
| 6058-1 | 0.010 |
| 5992-1 | 0.007 |
| 13475-1 | 0.015 |
| 13471-1 | 0.016 |
| 5970-1 | 0.005 |
| 5982-1 | 0.005 |
| 6007-1 | 0.009 |
| 5960-1 | 0.006 |
| 5972-1 | 0.007 |
| 5983-1 | 0.004 |
| 5995-1 | 0.006 |
| 5946-1 | 0.007 |
| 5961-1 | 0.004 |
| 5973-1 | 0.006 |
| 13472-1 | >0.523 |
| 5998-1 | 0.007 |
| 5947-1 | 0.003 |
| 5963-1 | 0.022 |
| 5975-1 | 0.022 |
| 5987-1 | 0.003 |
| 5999-1 | 0.005 |
| 5965-1 | 0.020 |
| 5976-1 | 0.010 |
| 5988-1 | 0.004 |
| 6000-1 | 0.002 |

Generation and Evaluation of Mesothelin×CD40 Bispecific Agonist Antibodies in the IgG-scFv Format.

A panel of mesothelin×CD40 bispecific antibodies were generated in the IgG-scFv format (Table 13) and evaluated for binding to soluble forms of human and cynomolgus monkey CD40 and human and cynomolgus monkey mesothelin using the Octet assay (Table 14). Association rate (Kon), disassociation rate (Kdis), and equilibrium binding constant (KD) were calculated. The majority of bispecific antibodies showed high affinity binding to both human and cynomolgus monkey CD40 and mesothelin. These bispecific antibodies were next evaluated for their ability to induce mesothelin-dependent activation of human B cells. CHO cells expressing human mesothelin were seeded into a 96 well plate. The next day varying concentrations of the mesothelin×CD40 IgG-scFv antibodies were added to the wells along with purified human B cells and the plates were incubated for an additional 48 hours. Upregulation of CD86, a marker of CD40-mediated B cell activation, was quantified on B cells by flow cytometry. EC50 values for CD86 upregulation were calculated and demonstrate that the majority of mesothelin×CD40 IgG-scFv bispecific antibodies were able to B cell activation in the presence of CHO cells expressing human mesothelin (Table 15).

TABLE 13

Anti-CD40xMSLN IgG-scFv molecules

| Antibody ID | IgG (MSLN) | scFv (CD40) | IgG (CD40) | scFv (MSLN) |
|---|---|---|---|---|
| 6028-2 | 4H6 | 36F3 | | |
| 6030-2 | 4H6 | 39C2 | | |
| 6032-2 | 6F4 | 29H10 | | |
| 6043-2 | | | 30A12 | 4H6 |
| 6044-2 | | | 30A12 | 6F4 |
| 6033-2 | 6F4 | 30A12 | | |
| 6034-2 | 6F4 | 33H6 | | |
| 6035-2 | 6F4 | 33H9 | | |
| 6056-2 | 6F4 | 39C2 | | |
| 6039-2 | | | 4G7 | 4H6 |
| 6040-2 | | | 4G7 | 6F4 |
| 6041-2 | | | 29H10 | 4H6 |
| 6042-2 | | | 29H10 | 6F4 |
| 6045-2 | | | 33H6 | 4H6 |
| 6046-2 | | | 33H6 | 6F4 |
| 6047-2 | | | 33H9 | 4H6 |
| 6048-2 | | | 33H9 | 6F4 |
| 6049-2 | | | 35F11 | 4H6 |
| 6050-2 | | | 35F11 | 6F4 |
| 6051-2 | | | 36F3 | 4H6 |
| 6052-2 | | | 36F3 | 6F4 |
| 6055-2 | | | 37A6 | 4H6 |
| 6054-2 | | | 37A6 | 6F4 |
| 6053-2 | | | 39C2 | 4H6 |
| 6023-2 | | | 39C2 | 6F4 |

TABLE 14

Anti-CD40xMSLN IgG-scFv molecule binding to human and cynomolgus monkey CD40 and mesothelin

| | huCD40(1-193) | | | cynoCD40(1-193) | | | huMSLN(296-598) | | | cynoMSLN(296-598) | | |
|---|---|---|---|---|---|---|---|---|---|---|---|---|
| Antibody ID | $K_D$ (nM) | $k_a$ ($M^{-1}s^{-1}$) | $k_d$ ($s^{-1}$) | $K_D$ (nM) | $k_a$ ($M^{-1}s^{-1}$) | $k_d$ ($s^{-1}$) | $K_D$ (nM) | $k_a$ ($M^{-1}s^{-1}$) | $k_d$ ($s^{-1}$) | $K_D$ (nM) | $k_a$ ($M^{-1}s^{-1}$) | $k_d$ ($s^{-1}$) |
| 6028-2 | 10 | 7.69E+04 | 7.67E-04 | 7.1 | 9.64E+04 | 6.87E-04 | 0.2 | 7.33E+05 | 1.43E-04 | 1.8 | 3.71E+05 | 6.80E-04 |
| 6030-2 | 7.9 | 2.14E+05 | 1.68E-03 | 6.0 | 3.01E+05 | 1.81E-03 | 0.2 | 7.08E+05 | 1.75E-04 | 1.9 | 3.53E+05 | 6.87E-04 |
| 6032-2 | 2.0 | 2.04E+05 | 4.07E-04 | 1.7 | 2.38E+05 | 4.07E-04 | 0.4 | 6.92E+05 | 3.06E-04 | 5.8 | 3.45E+05 | 1.99E-03 |
| 6043-2 | 1.2 | 3.21E+05 | 4.07E-04 | 0.9 | 4.22E+05 | 4.07E-04 | 0.1 | 4.44E+05 | 3.87E-05 | 4.3 | 2.76E+05 | 1.20E-03 |
| 6044-2 | 1.3 | 3.24E+05 | 4.24E-04 | 0.8 | 4.85E+05 | 3.98E-04 | 1.5 | 3.30E+05 | 5.06E-04 | 17 | 3.43E+05 | 5.87E-03 |
| 6033-2 | 4.2 | 3.11E+05 | 1.32E-03 | 2.9 | 4.88E+05 | 1.42E-03 | 0.4 | 4.49E+05 | 1.97E-04 | 5.9 | 3.31E+05 | 1.94E-03 |
| 6034-2 | 2.1 | 1.66E+05 | 3.50E-04 | 2.1 | 1.82E+05 | 3.84E-04 | 0.3 | 6.00E+05 | 1.96E-04 | 5.4 | 2.96E+05 | 1.59E-03 |
| 6035-2 | <0.1 | 1.03E+05 | <1.00E-05 | <0.1 | 9.43E+04 | <1.00E-05 | 0.3 | 6.75E+05 | 2.29E-04 | 6.3 | 2.71E+05 | 1.71E-03 |
| 6056-2 | 4.4 | 3.63E+05 | 1.59E-03 | 5.8 | 2.98E+05 | 1.74E-03 | 0.3 | 7.19E+05 | 2.18E-04 | 5.1 | 3.43E+05 | 1.76E-03 |
| 6039-2 | 1.4 | 1.12E+06 | 1.61E-03 | 2.1 | 1.04E+06 | 2.21E-03 | 0.3 | 5.13E+05 | 1.77E-04 | 5.4 | 2.81E+05 | 1.50E-03 |
| 6040-2 | 1.3 | 1.39E+06 | 1.86E-03 | 1.9 | 9.24E+05 | 1.73E-03 | 1.2 | 4.24E+05 | 5.16E-04 | 32 | 2.35E+05 | 7.63E-03 |
| 6041-2 | 0.5 | 7.09E+05 | 3.57E-04 | 0.6 | 5.39E+05 | 3.47E-04 | 0.4 | 5.04E+05 | 1.79E-04 | 5.7 | 1.58E+05 | 9.05E-04 |
| 6042-2 | 0.7 | 6.32E+05 | 4.29E-04 | 0.8 | 3.94E+05 | 3.03E-04 | 0.9 | 5.29E+05 | 4.60E-04 | 20 | 2.55E+05 | 5.04E-03 |
| 6045-2 | 0.4 | 8.81E+05 | 3.87E-04 | 0.6 | 5.80E+05 | 3.27E-04 | 0.3 | 5.23E+05 | 1.45E-04 | 4.6 | 1.87E+05 | 8.65E-04 |
| 6046-2 | 0.5 | 8.93E+05 | 4.05E-04 | 0.5 | 5.94E+05 | 3.14E-04 | 0.9 | 5.27E+05 | 4.76E-04 | 18 | 2.50E+05 | 4.59E-03 |
| 6047-2 | 0.2 | 5.77E+05 | 1.32E-04 | <0.3 | 3.46E+04 | <1.00E-05 | 0.4 | 3.75E+05 | 1.38E-04 | 6.0 | 1.68E+05 | 1.01E-03 |
| 6048-2 | 0.5 | 5.45E+05 | 2.59E-04 | 0.3 | 4.26E+05 | 1.33E-04 | 1.0 | 5.29E+05 | 5.53E-04 | 22 | 2.39E+05 | 5.35E-03 |
| 6049-2 | 0.9 | 8.34E+05 | 7.21E-04 | 1.2 | 5.06E+05 | 5.82E-04 | 0.3 | 5.36E+05 | 1.71E-04 | 5.1 | 1.85E+05 | 9.53E-04 |
| 6050-2 | 0.8 | 7.97E+05 | 6.49E-04 | 1.2 | 5.12E+05 | 6.09E-04 | 0.8 | 5.41E+05 | 4.51E-04 | 15 | 2.77E+05 | 4.27E-03 |
| 6051-2 | 3.5 | 1.24E+05 | 4.31E-04 | 4.7 | 1.00E+05 | 4.66E-04 | 0.2 | 5.99E+05 | 1.35E-04 | 5.5 | 1.91E+05 | 1.05E-03 |
| 6052-2 | 2.5 | 2.18E+05 | 5.56E-04 | 3.3 | 1.05E+05 | 3.50E-04 | 0.7 | 7.13E+05 | 5.33E-04 | 19 | 2.69E+05 | 5.19E-03 |
| 6055-2 | 0.5 | 1.46E+06 | 7.87E-04 | 0.8 | 7.45E+05 | 5.70E-04 | 0.4 | 5.52E+05 | 2.11E-04 | 6.1 | 1.79E+05 | 1.09E-03 |
| 6054-2 | 0.8 | 4.38E+05 | 3.33E-04 | 1.4 | 2.77E+05 | 4.00E-04 | 1.3 | 3.67E+05 | 4.62E-04 | 17 | 3.36E+05 | 5.78E-03 |
| 6053-2 | 0.9 | 4.53E+05 | 4.27E-04 | 0.5 | 2.63E+05 | 1.25E-04 | 0.4 | 3.41E+05 | 1.51E-04 | 4.3 | 2.52E+05 | 1.09E-03 |
| 6023-2 | 1.0 | 4.31E+05 | 4.40E-04 | 0.9 | 4.47E+05 | 4.13E-04 | 1.1 | 4.32E+05 | 4.60E-04 | 16 | 3.26E+05 | 5.35E-03 |

TABLE 15

Anti-CD40xMSLN IgG-scFv molecule functional activity on human B cells in the presence of CHO cells expressing human mesothelin

| Antibody ID | EC50 (nM) |
|---|---|
| 6028-2 | 0.012240302 |
| 6030-2 | 0.010141789 |
| 6032-2 | 0.009349861 |
| 6043-2 | 0.007758607 |
| 6044-2 | 0.005001671 |
| 6033-2 | 0.006030707 |
| 6034-2 | 0.007262489 |
| 6035-2 | 0.016708182 |
| 6056-2 | 0.004577206 |
| 6039-2 | 0.003317003 |
| 6040-2 | 0.002665906 |
| 6041-2 | 0.004479453 |
| 6042-2 | 0.003988474 |
| 6045-2 | 0.004663271 |
| 6046-2 | 0.004723116 |
| 6047-2 | 0.005131571 |
| 6048-2 | 0.004342491 |
| 6049-2 | 0.005853663 |
| 6050-2 | 0.003388309 |
| 6051-2 | 0.003753076 |
| 6052-2 | 0.003155443 |
| 6055-2 | 0.004340411 |
| 6054-2 | 0.003331971 |
| 6053-2 | 0.004033184 |
| 6023-2 | 0.002805537 |

Sequence Optimization of Mesothelin×CD40 Bispecific Agonist Antibodies in the IgG-scFv Format Engineering of select mesothelin×CD40 bispecific IgG-scFv antibodies was performed to remove potential sequence liabilities in the antibody heavy and light chain variable regions by standard recombinant DNA techniques. These antibodies were produced by over-expression in cell lines and purified using techniques that were known in the art. These bispecific antibodies were next evaluated for their ability to induce mesothelin-dependent activation of human B cells. CHO cells expressing human mesothelin were seeded into a 96 well plate. The next day varying concentrations of the mesothelin×CD40 IgG-scFv sequence variant antibodies were added to the wells along with purified human B cells and the plates were incubated for an additional 48 hours. Upregulation of CD86, a marker of CD40-mediated B cell activation, was quantified on B cells by flow cytometry. EC50 values for CD86 upregulation were calculated and demonstrate that the majority of mesothelin×CD40 IgG-scFv sequence variant bispecific antibodies maintain the ability to induce B cell activation in the presence of CHO cells expressing human mesothelin (Table 16).

TABLE 16

Sequence optimized anti-CD40xMSLN IgG-scFv molecule functional activity on human B cells in the presence of CHO cells expressing human mesothelin

| Antibody ID | EC50 (nM) |
|---|---|
| 8861-1 | 0.00332 |
| 8866-1 | 0.00306 |
| 8862-1 | 0.00295 |
| 8863-1 | 0.00557 |
| 8869-1 | 0.00181 |
| 8871-1 | 0.00259 |
| 8873-1 | 0.00311 |
| 8875-1 | 0.00241 |
| 8867-1 | 0.00216 |
| 8868-1 | 0.00363 |
| 8864-1 | 0.00283 |
| 8870-1 | 0.00267 |
| 8872-1 | 0.00267 |
| 8874-1 | 0.00262 |
| 8876-1 | 0.00171 |
| 8865-1 | 0.00329 |
| 6041-3 | 0.00395 |
| 8764-1 | 0.00434 |
| 8768-1 | 0.00334 |
| 8769-1 | 0.00434 |
| 8770-1 | 0.02176 |
| 8771-1 | 0.05341 |
| 8772-1 | 0.17205 |
| 8773-1 | 0.42410 |
| 8774-1 | 0.00409 |
| 8775-1 | 0.00309 |
| 8776-1 | 0.02073 |
| 8777-1 | 0.01153 |
| 8778-1 | 0.00362 |
| 8765-1 | 0.00305 |
| 8779-1 | 0.01746 |
| 8780-1 | 0.01673 |
| 8781-1 | 0.17750 |
| 8782-1 | 0.42500 |
| 8783-1 | 0.00301 |
| 8784-1 | 0.00311 |
| 8785-1 | 0.00293 |
| 8786-1 | 0.00322 |
| 8787-1 | 0.00274 |
| 8788-1 | 0.00371 |
| 8789-1 | 0.00321 |
| 8790-1 | 0.00480 |
| 8791-1 | 0.00329 |
| 8766-1 | 0.00355 |
| 8792-1 | 0.00439 |
| 8793-1 | 0.00405 |
| 8794-1 | 0.00378 |
| 8795-1 | 0.00511 |
| 8796-1 | 0.00437 |
| 8797-1 | 0.00384 |
| 8798-1 | 0.00342 |
| 8804-1 | 0.00323 |
| 8805-1 | 0.00406 |
| 8806-1 | 0.00326 |
| 8807-1 | 0.00342 |
| 8808-1 | 0.00331 |
| 8809-1 | 0.00386 |
| 8810-1 | 0.00451 |
| 8811-1 | 0.00436 |
| 8812-1 | 0.00415 |
| 8813-1 | 0.00356 |
| 8814-1 | 0.00453 |
| 8815-1 | 0.00368 |
| 8816-1 | 0.00438 |
| 8817-1 | 0.00342 |
| 8818-1 | 0.00518 |
| 8819-1 | 0.00387 |
| 8820-1 | 0.00366 |
| 8821-1 | 0.00433 |
| 8822-1 | 0.00404 |
| 8823-1 | 0.00351 |
| 8824-1 | 0.00331 |
| 8825-1 | 0.00255 |
| 8767-1 | 0.00209 |
| 8826-1 | 0.04585 |
| 8827-1 | 0.06588 |
| 8828-1 | >0.635 |
| 8829-1 | >0.635 |
| 8830-1 | 0.00559 |
| 8831-1 | 0.00523 |
| 8832-1 | 0.00572 |
| 8833-1 | 0.00788 |

TABLE 16-continued

Sequence optimized anti-CD40xMSLN IgG-scFv molecule functional activity on human B cells in the presence of CHO cells expressing human mesothelin

| Antibody ID | EC50 (nM) |
|---|---|
| 8834-1 | 0.03859 |
| 8835-1 | 0.06977 |
| 8836-1 | >0.635 |
| 8837-1 | >0.635 |
| 8838-1 | >0.635 |
| 8839-1 | >0.635 |
| 8840-1 | 0.00641 |
| 8841-1 | 0.00572 |
| 8842-1 | 0.00430 |
| 8843-1 | 0.00376 |
| 8844-1 | 0.00263 |
| 8845-1 | 0.00362 |
| 8846-1 | 0.00542 |
| 8847-1 | >0.635 |
| 8848-1 | 0.28130 |
| 8849-1 | 0.00315 |
| 8850-1 | 0.00353 |
| 8851-1 | 0.00648 |
| 8852-1 | 0.12325 |
| 8853-1 | 0.05720 |
| 6052-3 | 0.00445 |
| 8854-1 | 0.00303 |
| 8855-1 | 0.00354 |
| 8856-1 | 0.00363 |
| 8857-1 | 0.00346 |
| 8858-1 | 0.00357 |
| 8859-1 | 0.00300 |
| 8860-1 | 0.00357 |

Figure 4:
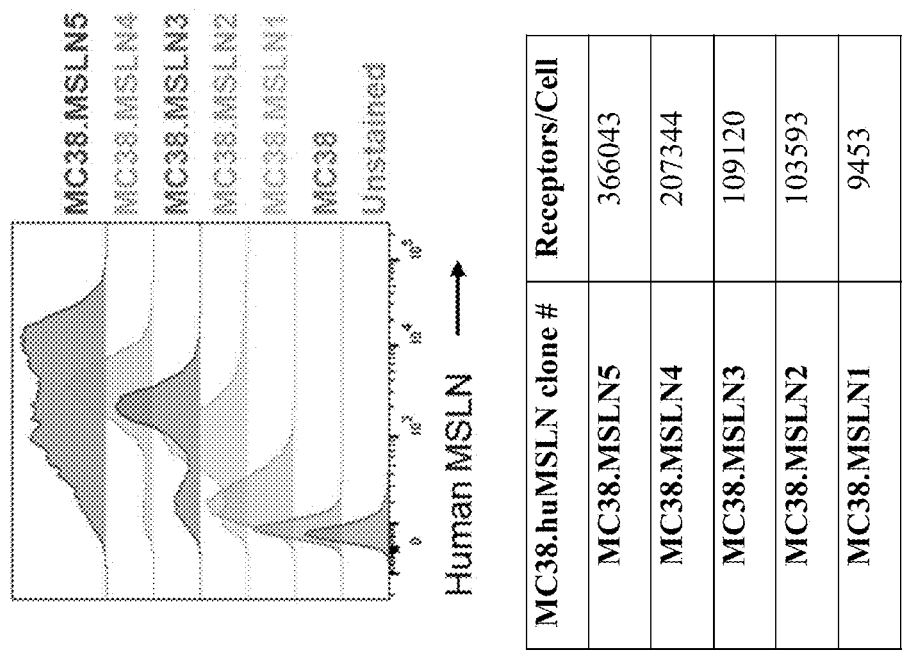
FIG. 4 depicts Generation of cell lines expressing varying levels of MSLN.

Effect of Varying Levels of Mesothelin on Activity of Select MesothelinxCD40 Bispecific Antibodies in a Human B Cell Functional Assay MC38 cells were engineered to express varying levels of human mesothelin ranging from low (MC38.MSLN1) to high (MC38.MSLN5). Given that MC38 cells are derived from mouse, they do not express human mesothelin (FIG. 4). Parental MC38 cells and MC38 cells expressing varying levels of human mesothelin were seeded into 96 well plates and cultured overnight. The next day, mesothelinxCD40 bispecific antibodies were added to the cells at varying concentrations. Isolated human B cells were then added at to the wells and the plates were incubated for an additional 48 hours. Upregulation of CD86 on B cells was evaluated by flow cytometry and used as a measure of B cell activation. EC50 and maximum activity (Emax) values were calculated and demonstrate that the mesothelinxCD40 bispecific antibodies were able to induce B cell activation across all levels of MSLN expression (Table 17). Cell lines expressing lower levels of mesothelin induced lower maximum activity of the mesothelinxCD40 bispecific antibodies, as measured by the geometric mean fluorescence intensity of CD86 upregulation on B cells. MesothelinxCD40 bispecific antibodies had no activity in the presence of parental MC38 cells, consistent with the mesothelin-dependent activity of these molecules for CD40 agonist activity.

TABLE 17

Activity of anti-CD40xMSLN bispecific molecules in human B cell and monocyte-derived dendritic cell assays in the presence of varying levels of mesothelin

| | | Antibody ID | | | | | |
|---|---|---|---|---|---|---|---|
| | | 6041 | 8765 | 8766 | 8767 | 8945 | 8947 |
| Human B Cell Functional Assay (CD86 upregulation) | MC38.MSLN1 EC50 (pM) | 0.2326 | 0.2287 | 0.2735 | 0.1472 | 0.2752 | 0.2687 |
| | MC38.MSLN2 EC50 (pM) | 0.5723 | 0.6028 | 0.6877 | 0.4584 | 0.6637 | 0.6626 |
| | MC38.MSLN3 EC50 (pM) | 0.801 | 0.6696 | 0.8764 | 0.5357 | 1.0162 | 0.6689 |
| | MC38.MSLN4 EC50 (pM) | 0.9542 | 0.8518 | 1.1365 | 0.7048 | 1.4765 | 0.9471 |
| | MC38.MSLN5 EC50 (pM) | 1.6005 | 0.8549 | 2.0058 | 1.2579 | 2.0122 | 1.0863 |
| | MC38 parental EC50 (pM) | ∞ | ∞ | ∞ | ∞ | ∞ | ∞ |
| | MC38.MSLN1 Emax (MFI) | 803.9 | 903 | 849 | 742.1 | 660.2 | 809.5 |
| | MC38.MSLN2 Emax (MFI) | 1169 | 1318 | 1223 | 1173 | 978.6 | 1259 |
| | MC38.MSLN3 Emax (MFI) | 1895 | 1861 | 1869 | 1849 | 1479 | 1733 |
| | MC38.MSLN4 Emax (MFI) | 1325 | 1400 | 1399 | 1341 | 1283 | 1406 |
| | MC38.MSLN5 Emax (MFI) | 1396 | 1406 | 1474 | 1349 | 1186 | 1389 |
| | MC38 parental Emax (MFI) | Bkgd | Bkgd | Bkgd | Bkgd | Bkgd | Bkgd |

TABLE 17-continued

Activity of anti-CD40xMSLN bispecific molecules in human B cell and monocyte-derived dendritic cell assays in the presence of varying levels of mesothelin

| | | Antibody ID | | | | | |
|---|---|---|---|---|---|---|---|
| | | 6041 | 8765 | 8766 | 8767 | 8945 | 8947 |
| Human Monocyte-Derived Dendritic Cell Functional Assay (IL12p40 production) | MC38.MSLN2 EC50 (nM) | 0.179 | 0.089 | 0.183 | 0.101 | 0.168 | 0.184 |
| | MC38.MSLN5 EC50 (nM) | 0.241 | 0.231 | 0.26 | 0.248 | 0.414 | 0.399 |
| | MC38 parental EC50 (nM) | ∞ | ∞ | ∞ | ∞ | ∞ | ∞ |
| | MC38.MSLN2 Emax (IL12p40 pg/ml) | 1142 | 952 | 1205 | 1116 | 338.1 | 1010 |
| | MC38.MSLN5 EC50 (nM) | 2400 | 2148 | 2343 | 2349 | 1004 | 1869 |
| | MC38 parental Emax (IL12p40 pg/ml) | Bkgd | Bkgd | Bkgd | Bkgd | Bkgd | Bkgd |

* Poor curve fit
Bkgd = Background level of assay

Effect of Varying Levels of Mesothelin on Activity of Select MesothelinxCD40 Bispecific Antibodies in a Monocyte-Derived Dendritic Cell Functional Assay.

MC38 cells engineered to express varying levels of human mesothelin (FIG. 4) or parental MC38 cells were seeded into 96 well plates and cultured overnight. The next day, mesothelinxCD40 bispecific antibodies were added to the cells at varying concentrations. Monocyte-derived dendritic cells differentiated from human monocytes using GMCSF and IL4 were added to the wells and the plates were incubated for an additional 48 hours. Supernatants from each well were collected and concentrations of IL12p40 secreted from dendritic cells quantified using an ELISA kit. EC50 and maximum activity (Emax) values were calculated and demonstrate that the mesothelinxCD40 bispecific antibodies were able to induce dendritic cell activation across both high and low levels of MSLN expression (Table 17). Cell lines expressing lower levels of mesothelin induced lower maximum activity of the mesothelinxCD40 bispecific antibodies. MesothelinxCD40 bispecific antibodies had no activity in the presence of parental MC38 cells, consistent with the mesothelin-dependent activity of these molecules for CD40 agonist activity.

Activity of Select MesothelinxCD40 Bispecific Antibodies in Cynomolgus Monkey B Cell Functional Assay with Cynomolgus Monkey Mesothelin-Expressing CHO Cells.

CHO cells engineered to express cynomolgus monkey mesothelin were seeded into 96 well plates and cultured overnight. The next day, select mesothelinxCD40 bispecific antibodies were added to the cells at varying concentrations. Isolated cynomolgus monkey B cells were then added at to the wells and the plates were incubated for an additional 48 hours. Upregulation of CD23 on the cynomolgus monkey B cells was evaluated by flow cytometry and used as a measure of CD40-induced B cell activation. EC50 were calculated and demonstrate that the mesothelinxCD40 bispecific antibodies are able to induce activation of cynomolgus monkey B cells in the presence of cynomolgus monkey mesothelin (Table 18).

TABLE 18

Activity of anti-CD40xMSLN bispecific molecules on cynomolgus monkey B cells stimulated with CHO cells expressing cynomolgus monkey mesothelin

| Antibody ID | EC50 (nM) |
|---|---|
| 6041 | 0.0012 |
| 8765 | 0.0013 |
| 8766 | 0.0016 |
| 8767 | 0.0014 |
| 8945 | 0.0018 |
| 8947 | 0.0014 |

Pharmacokinetics and Stability of MesothelinxCD40 Bispecific Antibodies in Mice.

Figure 5:
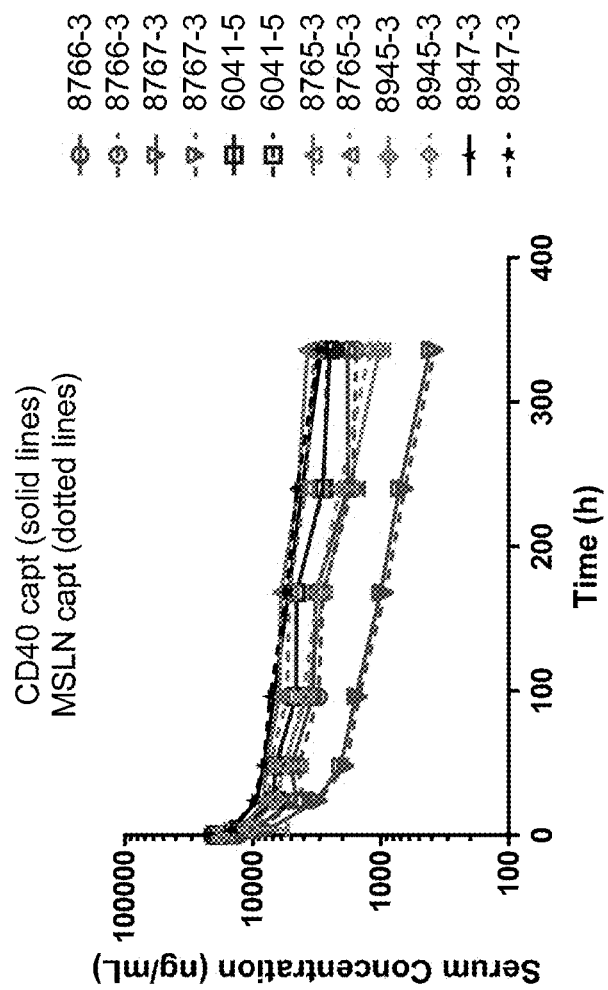
FIG. 5 depicts Pharmacokinetic properties and stability of anti-CD40×MSLN bispecific molecules in mouse.

In order to characterize the stability of mesothelinxCD40 bispecific antibodies in vivo, select mesothelinxCD40 bispecific molecules were injected into mice a 1 mg/kg dose. Animals were bled at varying timepoints after injection and serum isolated Immunoassays were used to quantify the concentration of mesothelinxCD40 bispecific antibodies in serum, either capturing with human CD40 and detecting with anti-human IgG or capturing with human mesothelin and detecting with anti-human IgG. The combination of these two assays provide the ability to detect molecule degradation or instability. The CD40 or mesothelin capture assays yielded equivalent results, suggesting the molecules remained intact over the course of 14 days in vivo (FIG. 5). All molecules with the exception of one had similar pharmacokinetic properties.

Immunostimulatory and Anti-Tumor Activity of a Tumor-Targeted CD40 Agonist Bispecific Antibody in Mouse Models Generation of a Mouse Surrogate Human EPCAM-Dependent CD40 Agonist Bispecific Antibody and Human EPCAM-Expressing Mouse Tumor Cell Lines.

The anti-mouse CD40 agonist antibody (clone FGK45) and anti-human EPCAM antibody (clone 4-7) was used to generate a surrogate CD40 bispecific antibody in the IgG-scFv format with a mouse IgG1 N297G Fc domain (anti-muCD40xhuEPCAM bispecific antibody). The bispecific antibody contains anti-CD40 at the N-terminus of the molecule and the anti-EPCAM as scFv at the C-terminus of the molecule. Human EPCAM was over-expressed in the mouse MC38 colon carcinoma cell line and the mouse B16F10 melanoma cell line by transduction with a retrovirus encoding both human EPCAM and the human truncated nerve growth factor receptor (NGFR) reporter gene (FIG. 6). Human EpCAM-MC38 or human EpCAM-B16 tumor cells were inoculated in the right flank at 3e5 cells per implant and allowed to grow for 24 days or 11 days, respectively. Tumors were measured twice a week with digital calipers, demonstrating that the tumor cell lines expressing human EPCAM maintained the ability to grow and form tumors in mice. Flow cytometry on tumors harvested from mice and subjected to enzymatic disassociation demonstrated that human EPCAM expression was maintained on the surface of tumor cells during in vivo tumor formation (FIG. 6).

Human EPCAM-Dependent Agonist Activity of the EPCAM×CD40 Agonist Antibody on Mouse B Cells.

Figure 7A:
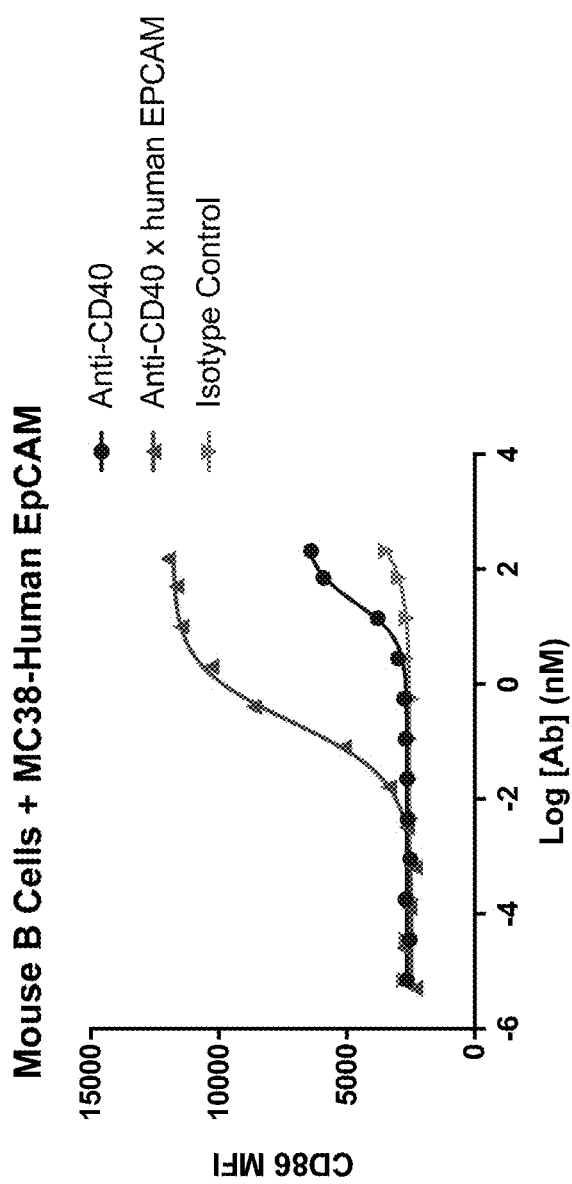
FIGS. 7A-7B depict Activity of mouse surrogate anti-CD40×human EPCAM bispecific molecule.
Figure 7B:
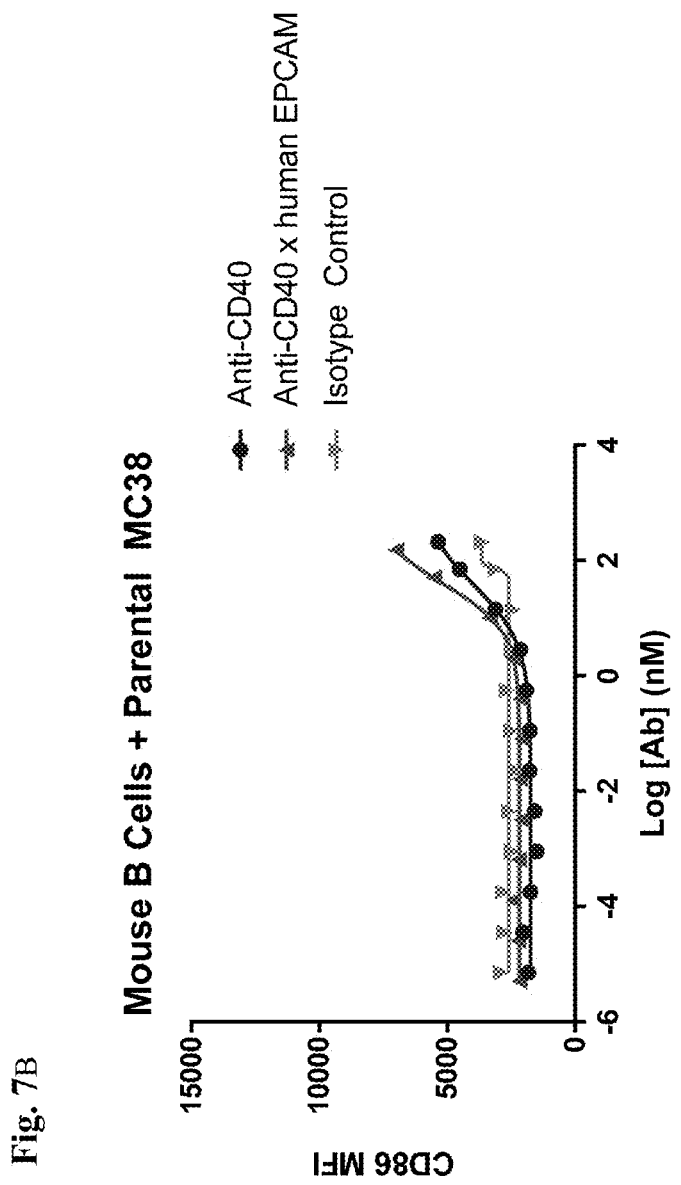

Human EpCAM overexpressing MC38 cells (huEpCAM-MC38) or parental MC38 cells were seeded into 96 plates and cultured overnight. The next day, the anti-muCD40×huEPCAM bispecific antibody, the parental anti-CD40 antibody (FGK54), or an isotype control antibody was added to the cells at varying concentrations. Isolated mouse B cells were then added at to the wells and the plates were incubated for an additional 48 hours. Upregulation of CD86 on B cells was evaluated by flow cytometry and used as a measure of B cell activation. EC50 values were calculated and demonstrate that the anti-muCD40×huEPCAM bispecific antibody was able to induce mouse B cell activation (FIG. 7). The anti-muCD40×huEPCAM bispecific antibody demonstrated robust agonist activity that was dependent on the presence of human EPCAM and showed dramatically higher potency in activating B cells compared to the FGK45 anti-CD40 monoclonal antibody.

Figure 9:
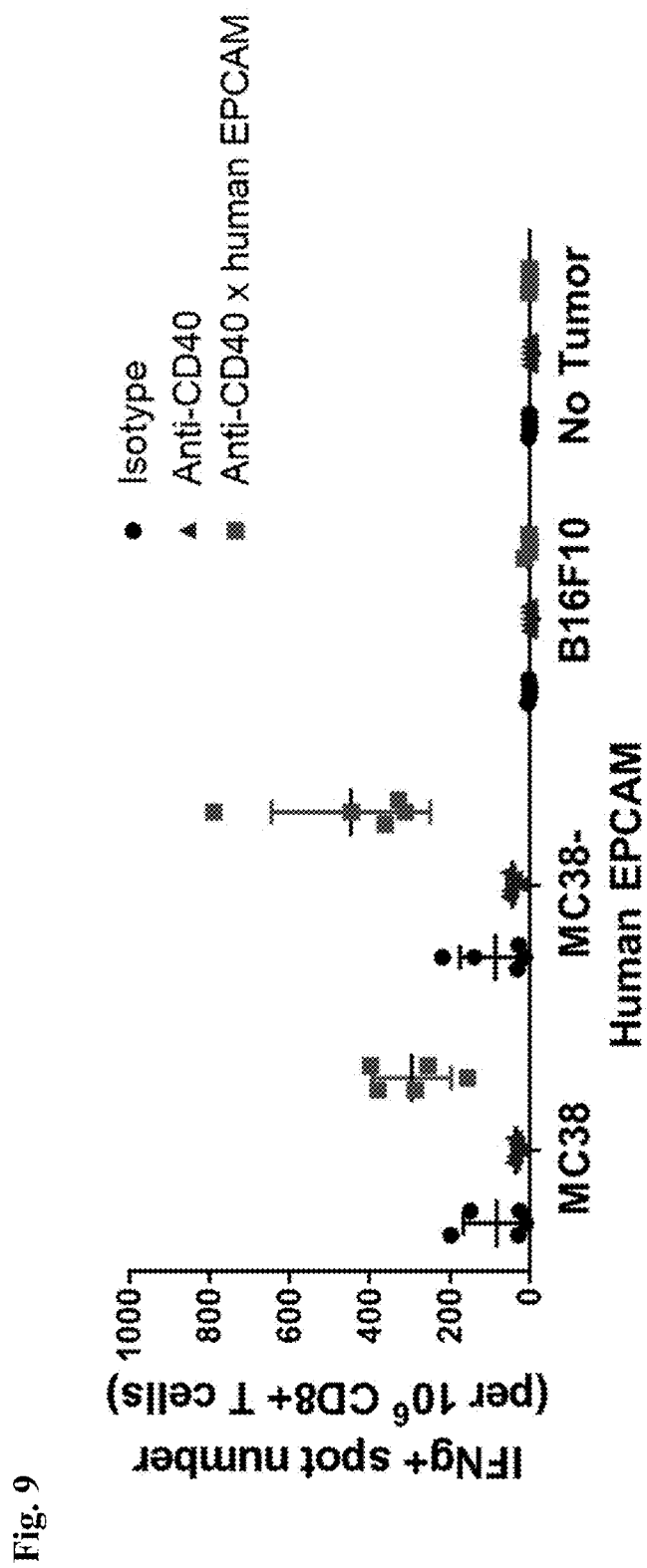
FIG. 9 depicts Mouse surrogate anti-CD40×human EPCAM bispecific molecule enhances CD8+ T cell antitumor responses.

In Vivo Immunostimulatory Activity of the Anti-muCD40×huEPCAM Bispecific Antibody in the MC38 Tumor Model To evaluate the effect of a tumor-targeted CD40 agonist bispecific antibody on immune cell activation in vivo, human EpCAM-expressing MC38 tumor cells were inoculated in the right flank of mice at 3e5 cells per implant and allowed to grow for 8-10 days. The mice were then randomized by tumor volume (60-100 mm3) and treated with indicated antibodies administered intraperitoneally at 5 mg/kg. Tumors, tumor draining lymph nodes (dLNs), and non-draining lymph nodes (ndLNs) were harvested at 24-48 hours post-treatment and single cell suspension prepared by enzymatic digestion of tissues. Flow cytometry analysis was performed to determine cell proportion and phenotypes, staining for surface immune cell lineage markers and activation markers, and intracellular cytokines (FIG. 8). As expected, CD40 agonist antibody (anti-CD40) treatment activated dendritic cells (DCs) located in tumor and in peripheral tissues including dLN and ndLN. In contrast, the anti-muCD40×huEPCAM bispecific antibody only activated tumor infiltrating DCs in the human EPCAM-expressing MC38 tumors, but not DCs in peripheral tissues (dLN and ndLN) (FIG. 8A). In addition, the anti-muCD40×huEPCAM bispecific antibody increased the CD8 T cell to regulatory T cell ratio and interferon gamma (IFNg)-producing CD4+ T cells in the tumor (FIG. 8B). Total T cells were also isolated from spleens of huEpCAM-expressing MC38 tumor-bearing mice that had been treated with the indicated antibodies. Bone marrow-derived dendritic cells (BMDCs) were generated from naïve C57BL/6 bone marrow cells by incubating with recombinant GM-CSF and IL4 for 7 days. BMDCs were pulsed with the indicated tumor cells overnight and then co-cultured with isolated T cells for 18 hours. An ELISPOT assay was used to measure the production of IFNg by antigen specific T cells, demonstrating that the anti-muCD40×huEPCAM bispecific antibody significantly increases T cells specific for both human EPCAM-expressing MC38 and parental MC38 antigens (FIG. 9). Taken together, these data demonstrate that a tumor-targeted CD40 agonist bispecific antibody can activate myeloid population in the tumor, such as DCs, in a tumor-associated antigen dependent manner, leading to enhanced anti-tumor T cell responses.

Figure 10A:
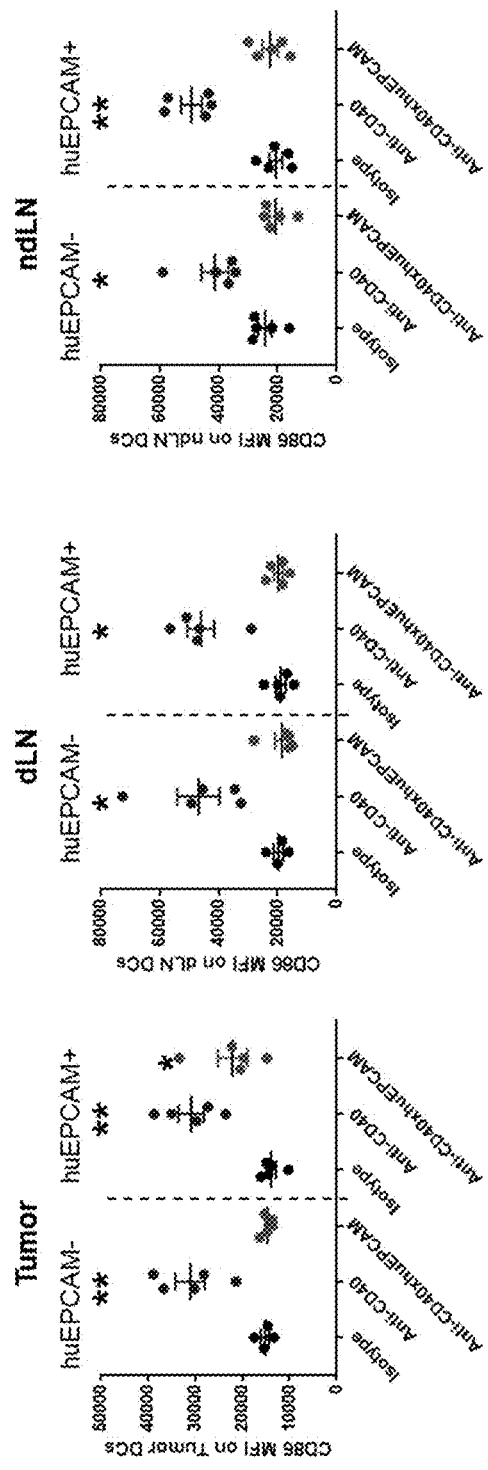
FIGS. 10A-10B depict Mouse surrogate anti-CD40×human EPCAM bispecific molecule has tumor-localized, TAA-mediated X-linking-dependent activity in vivo.
Figure 10B:
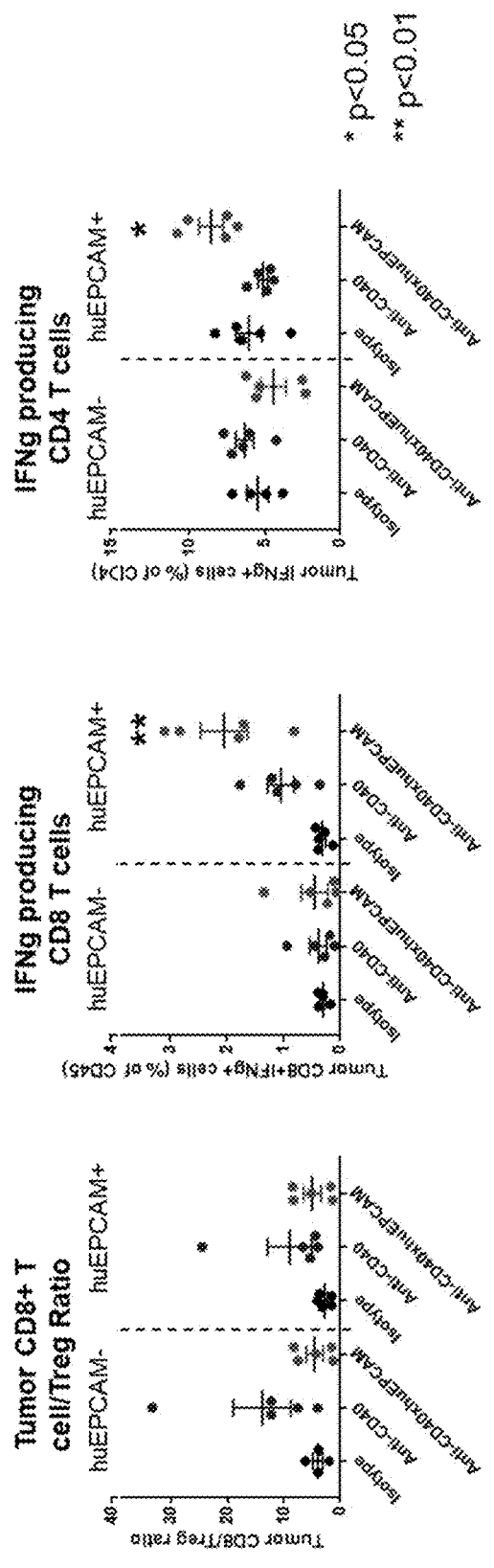

In Vivo Immunostimulatory Activity of the Anti-muCD40×huEPCAM Bispecific Antibody in the B16F10 Tumor Model To evaluate the effect of a tumor-targeted CD40 agonist bispecific antibody on immune cell activation in an additional tumor model, vector control or human EpCAM-expressing B16F10 tumor cells were inoculated in the right flank of mice at 3e5 cells per implant and allowed to grow for 8-10 days. The mice were then randomized by tumor volume (60-100 mm3) and treated with indicated antibodies administered intraperitoneally at 5 mg/kg. Tumors, tumor dLNs, and ndLNs were harvested at 24-48 hours post-treatment and single cell suspension prepared by enzymatic digestion of tissues. Flow cytometry analysis was performed to determine cell proportion and phenotypes, staining for surface immune cell lineage markers and activation markers, and intracellular cytokines (FIG. 10). As expected, CD40 agonist antibody (anti-CD40) treatment DCs located in tumor and in peripheral tissues including dLN and ndLN in parental huEpCAM negative B16F10 tumors and in huEpCAM-expressing B16F10 tumors. In contrast, the anti-muCD40×huEPCAM bispecific antibody only activated tumor infiltrating DCs in huEpCAM-expressing B16F10 tumors, but not in parental huEpCAM-B16F10 tumor. The anti-muCD40×huEPCAM bispecific antibody did not activate DCs in dLN or ndLN, regardless of whether these mice had human EPCAM-expressing or non-expressing B16F10 tumors (FIG. 10A). In addition, the anti-muCD40×huEPCAM bispecific antibody increased IFNg-producing effector CD4+ and CD8+ T cells in human EPCAM-expressing B16F10 tumors, but not in parental B16F10 tumors (FIG. 10B). These data provide additional evidence that a tumor-targeted CD40 agonist bispecific antibody can activate tumor infiltrating immune cells in a tumor-associated antigen dependent manner to enhance anti-tumor T cell responses.

Figure 11A:
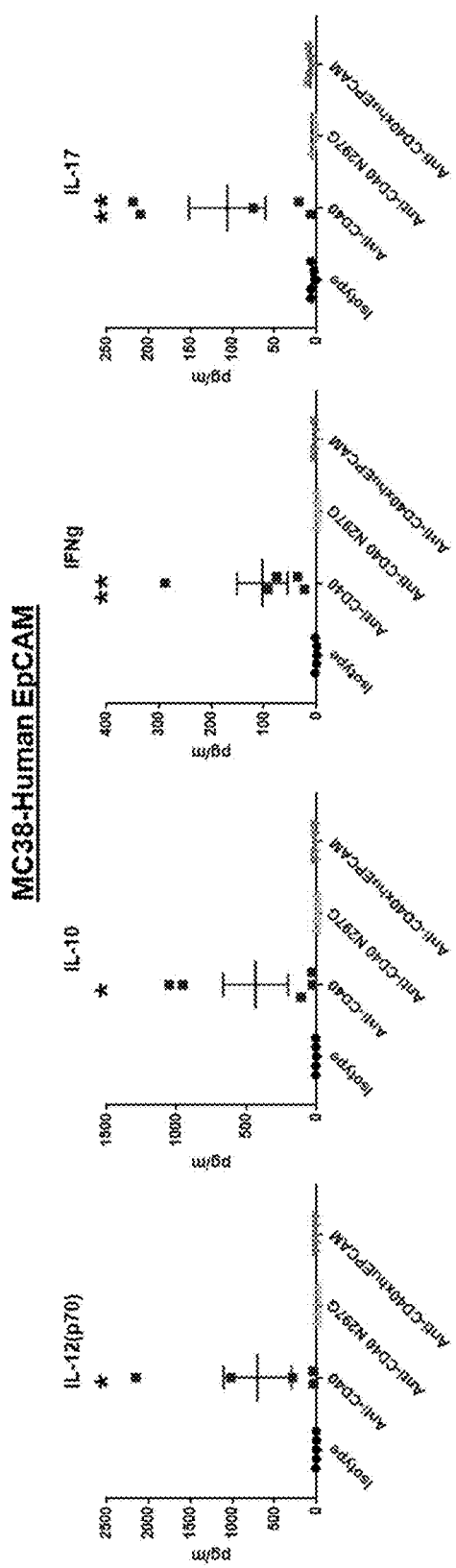
FIGS. 11A-11C depict Mouse surrogate anti-CD40×human EPCAM bispecific molecule does not increase levels of systemic cytokines or increase liver inflammation.
Figure 11B:
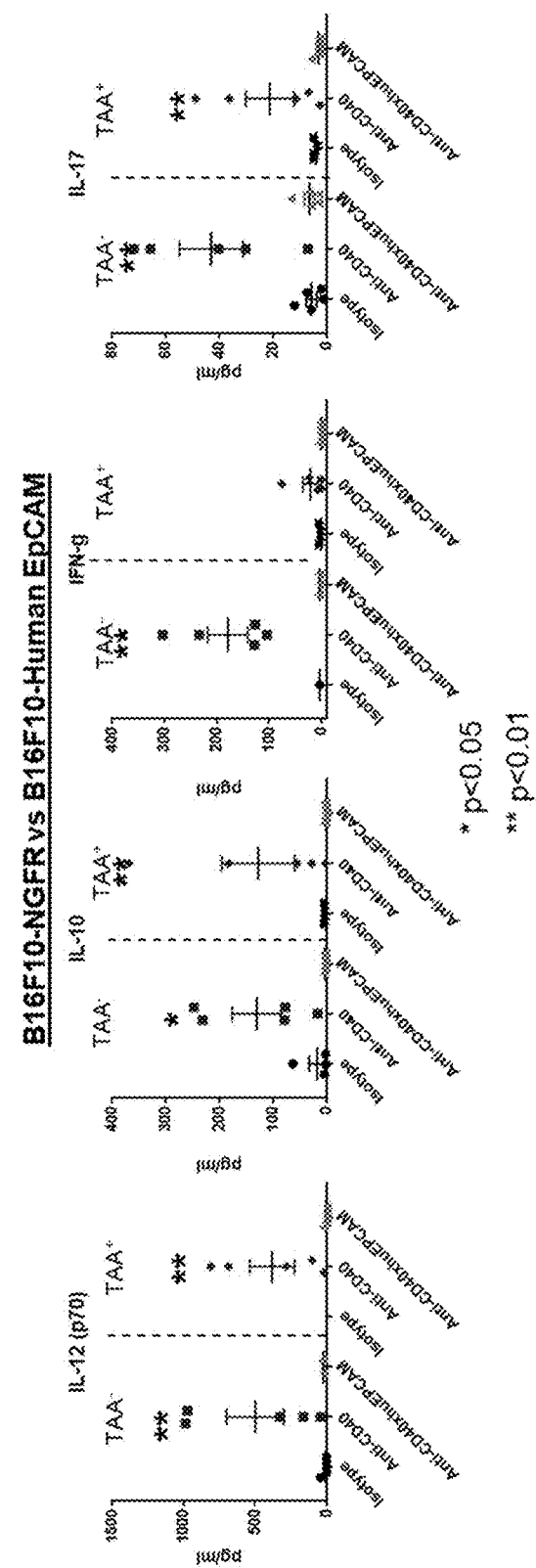
Figure 11C:
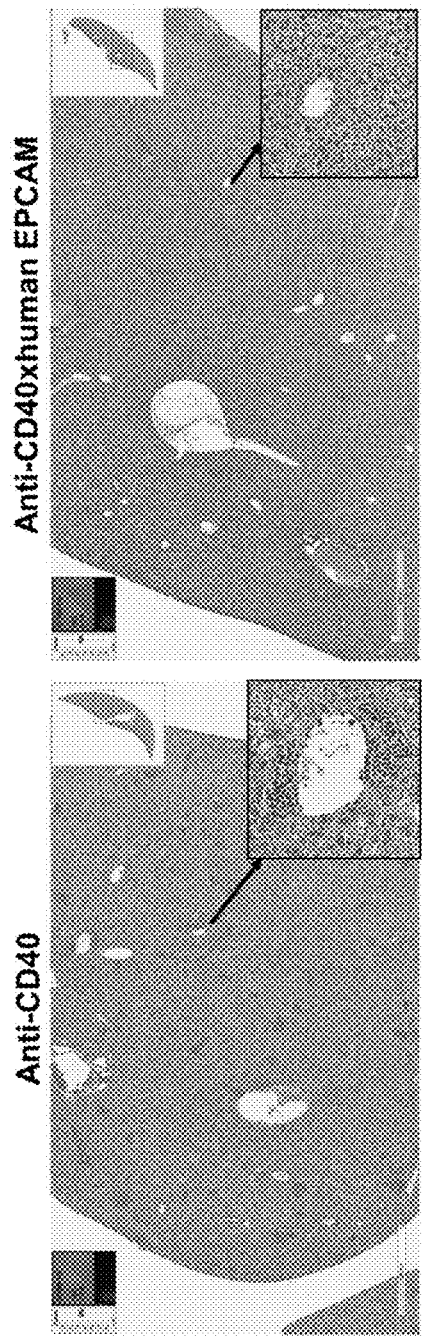

The Anti-muCD40×huEPCAM Bispecific Antibody does not Induce Upregulation of Systemic Serum Cytokines or Liver Damage in Mice CD40 agonist antibodies have shown dose-limiting toxicities in clinical trials, including liver damage and elevated serum cytokine levels, presumably due to systemic immune cell activation. To compare systemic immune cell activation and liver damage between a non-targeted CD40 agonist antibody and a tumor-targeted CD40 agonist bispecific antibody, mice bearing established human EPCAM-expressing MC38 tumors (described above) were treated with a non-specific isotype control antibody, a murine CD40 agonist antibody (anti-CD40), a CD40 antibody bearing a mutation in the Fc domain that decreases Fc receptor binding rendering it a poor agonist (anti-CD40 N297G), or the anti-muCD40×huEPCAM bispecific antibody (anti-CD40× huEPCAM) and serum was collected 24-48 hours later. Concentrations of select cytokines was measured using mouse cytokine/chemokine multiplex assay kit. The anti-CD40 antibody increased concentrations of several proinflammatory cytokines in the serum of mice, consistent with systemic immune cell activation. In contrast, neither the anti-CD40 N297G nor the anti-muCD40×huEPCAM bispecific antibody induced increased serum cytokine concentrations (FIG. 11A) Similar results were observed in the B16F10 tumor model, where, in contrast to the non-targeted anti-CD40 antibody, the anti-muCD40×huEPCAM bispecific antibody did not induce an increase in serum cytokine concentrations in either mice bearing vector control B16F10 tumors or mice bearing human EPCAM-expressing B16F10 tumors (FIG. 11B). The livers of mice bearing human EPCAM-expressing MC38 tumors and treated with anti-CD40 agonist antibody or the anti-muCD40×huEPCAM bispecific antibody were also were fixed in 10% Neutral buffered formalin, embedded in paraffin, sectioned, and stained with Hematoxylin and Eosin for histological analysis. While the anti-CD40 agonist antibody induced multifocal mononuclear cell infiltration in the liver and these livers contained single cell necrosis figures, livers from the anti-muCD40×huEPCAM bispecific antibody-treated mice did not show any distinguishable histopathological changes (FIG. 11C). Taken together, these data indicate that a tumor-targeted CD40 agonist antibody is capable of inducing local immune cell activation in the tumor, without leading to systemic cytokine production or liver damage that has been associated with anti-CD40-mediated toxicity.

Figure 12A:
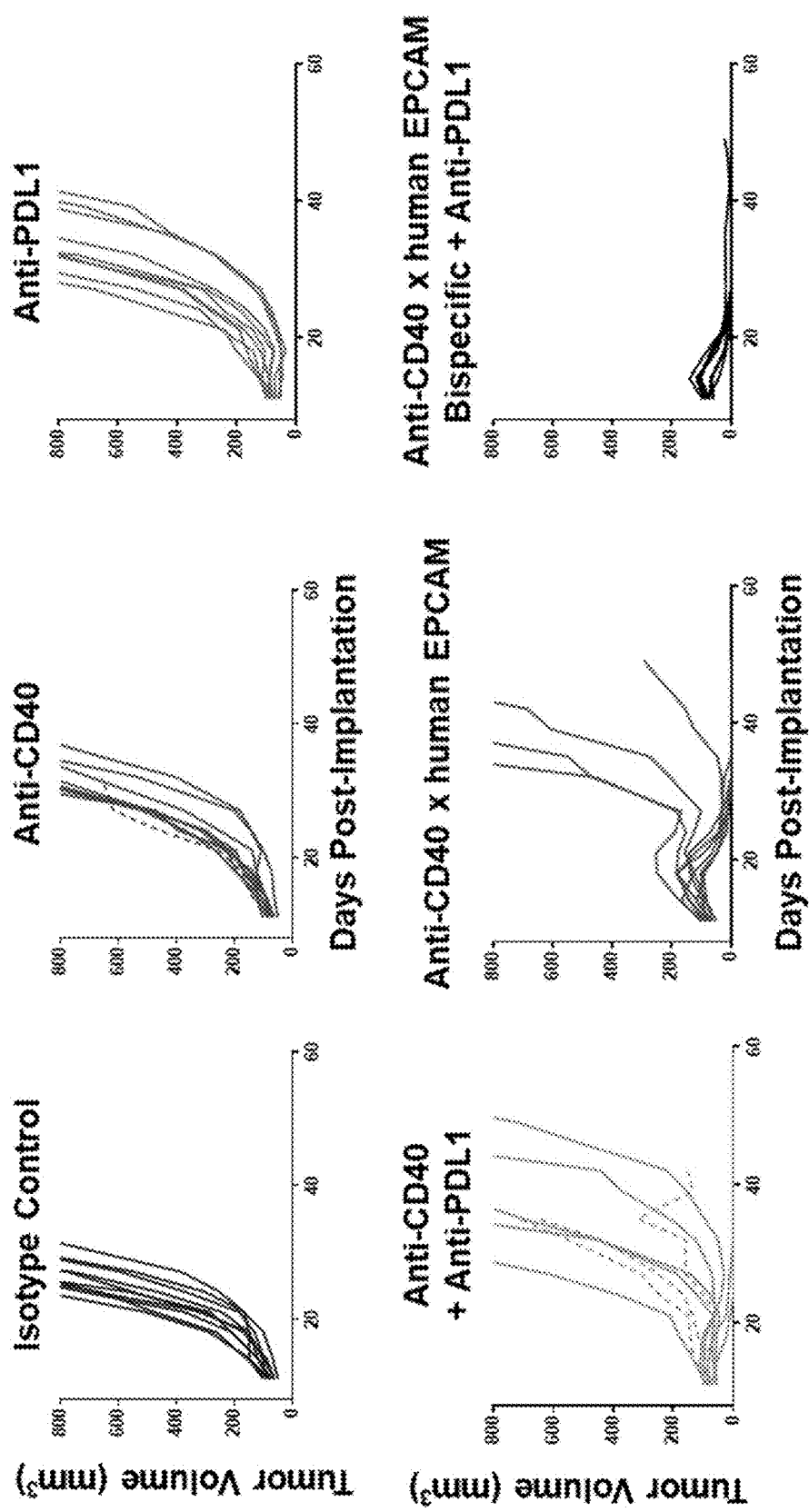
FIGS. 12A-12B depict Mouse surrogate anti-CD40×human EPCAM bispecific molecule induces regression of established MC38-human EPCAM tumors alone and in combination with PD1/PDL1 blockade.
Figure 12B:
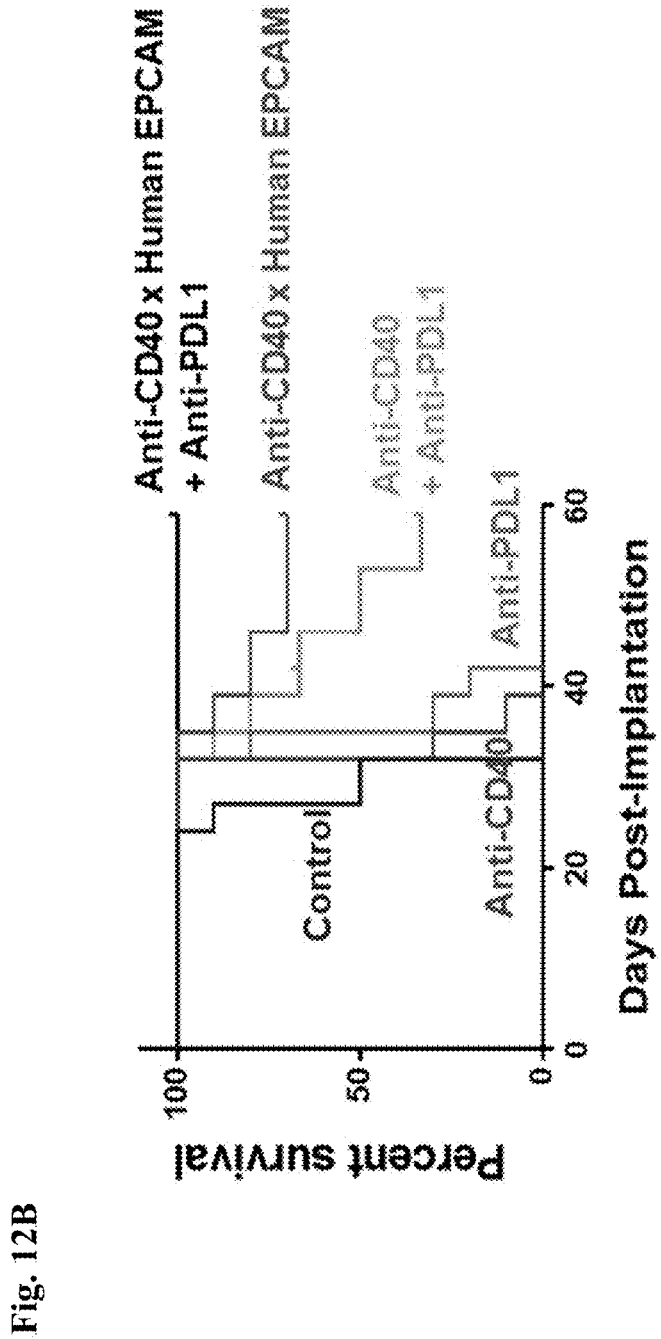
Figure 13:
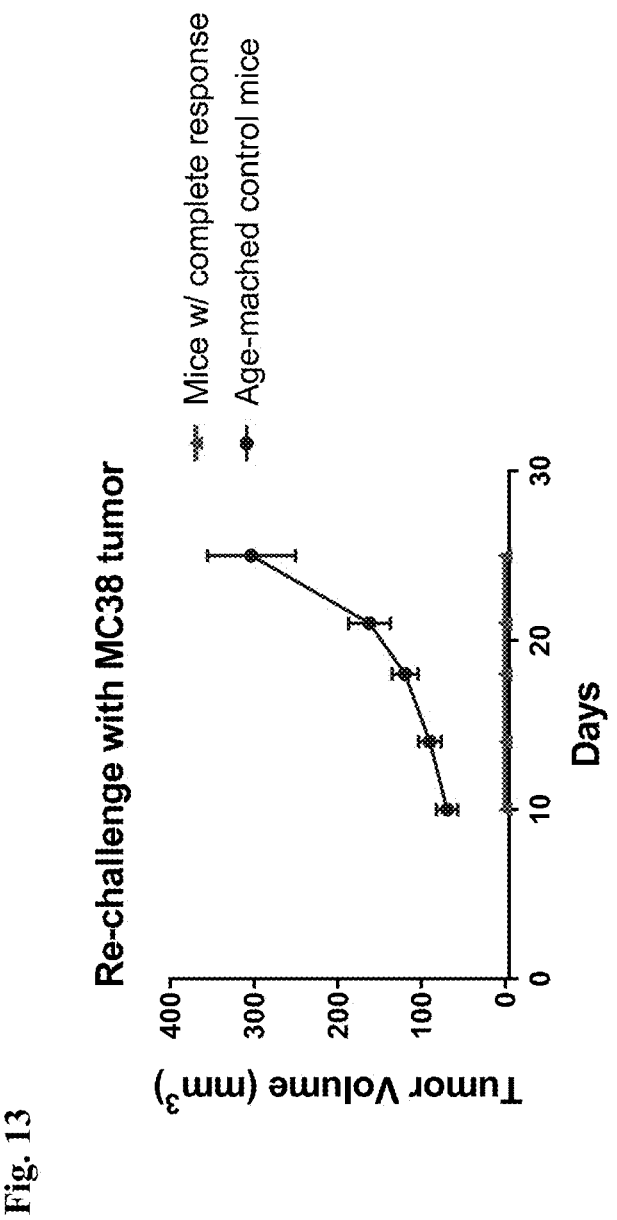
FIG. 13 depicts Mouse surrogate anti-CD40×human EPCAM bispecific molecule induces long-lasting immune memory that protects against tumor re-challenge.

Anti-Tumor Effects of Human EPCAM×Murine CD40 Bispecific Antibody in Mouse Tumor Model To evaluate the effect of a tumor-targeted CD40 agonist antibody on immune-mediated inhibition of tumor growth and the potential for this therapeutic approach to combine with blockade of the immune checkpoint inhibitor PD1, mice bearing human EPCAM-expressing MC38 tumors were treated with an isotype control antibody, anti-CD40 agonist antibody, anti-PDL1 (that blocks interactions between PD1 and PDL1), anti-muCD40×huEPCAM bispecific antibody, the combination of anti-CD40 with anti-PDL1, and the combination of anti-muCD40×huEPCAM bispecific with anti-PDL1 (FIG. 12). Single agent treatment with anti-CD40 agonist antibody or anti-PDL1 blocking antibody had minimal effect on tumor growth (FIG. 12A) or on improving survival (FIG. 12B) relative to isotype control antibody treatment, while the combination of anti-CD40 agonist and anti-PDL1 significantly inhibited tumor growth. Strikingly, treatment with the anti-muCD40×huEPCAM bispecific agonist antibody dramatically inhibited tumor growth and increased animal survival compared to other monotherapy treatments. Moreover, the combination of the anti-muCD40×huEPCAM bispecific antibody with anti-PDL1 led to complete regression of tumors, with all animals surviving until the end of the study. These complete responder animals were housed for 3 months without treatment and no evidence of tumor reappearance, after which they were subject to tumor re-challenge with either human EPCAM-expressing MC38 tumor cells or B16F10 tumor cells (FIG. 13). These animals complete rejected the human EpCAM-expressing MC38 tumor cells, while control B16F10 tumor grew as expected. Both tumor lines grew as expected in age-matched control animals that had not previously been exposed to human EPCAM-expressing MC38 tumors or the anti-muCD40×huEPCAM bispecific antibody. Taken together, these data demonstrate that tumor-targeted CD40 agonist antibody therapy can enhance anti-tumor immune responses, leading to regression of established tumors that is further enhanced by combination with PD1/PDL1 blockade. In addition, the combination of tumor-targeted CD40 agonist treatment with PD1/PDL1 blockade can induce long-lasting immune memory that can protect against subsequent tumor re-challenge All publications, patents, and patent applications discussed and cited herein are hereby incorporated by reference in their entireties. It is understood that the disclosed invention is not limited to the particular methodology, protocols and materials described as these can vary. It is also understood that the terminology used herein is for the purposes of describing particular embodiments only and is not intended to limit the scope of the appended claims.

Those skilled in the art will recognize, or be able to ascertain using no more than routine experimentation, many equivalents to the specific embodiments of the invention described herein. Such equivalents are intended to be encompassed by the following claims.

Human CD40>NP_001241.1 Tumor Necrosis Factor Receptor Superfamily Member 5 Isoform 1 Precursor [*Homo sapiens*]

(SEQ ID NO: 1)
MVRLPLQCVLWGCLLTAVHPEPPTACREKQYLINSQCCSLCQPGQKLVSD

CTEFTETECLPCGESEFLDTWNRETHCHQHKYCDPNLGLRVQQKGTSETD

TICTCEEGWHCTSEACESCVLHRSCSPGFGVKQIATGVSDTICEPCPVGF

FSNVSSAFEKCHPWTSCETKDLVVQQAGTNKTDVVCGPQDRLRALVVIPI

IFGILFAILLVLVFIKKVAKKPTNKAPHPKQEPQEINFPDDLPGSNTAAP

VQETLHGCQPVTQEDGKESRISVQERQ

Human Mesothelin >NP_005814.2 Mesothelin Isoform 1 Preproprotein [*Homo sapiens*]

(SEQ ID NO: 2)
MALPTARPLLGSCGTPALGSLLFLLFSLGWVQPSRTLAGETGQEAAPLDG

VLANPPNISSLSPRQLLGFPCAEVSGLSTERVRELAVALAQKNVKLSTEQ

LRCLAHRLSEPPEDLDALPLDLLLFLNPDAFSGPQACTRFFSRITKANVD

LLPRGAPERQRLLPAALACWGVRGSLLSEADVRALGGLACDLPGRFVAES

AEVLLPRLVSCPGPLDQDQQEAARAALQGGGPPYGPPSTWSVSTMDALRG

LLPVLGQPIIRSIPQGIVAAWRQRSSRDPSWRQPERTILRPRFRREVEKT

ACPSGKKAREIDESLIFYKKWELEACVDAALLATQMDRVNAIPFTYEQLD

VLKHKLDELYPQGYPESVIQHLGYLFLKMSPEDIRKWNVTSLETLKALLE

VNKGHEMSPQVATLIDRFVKGRGQLDKDTLDTLTAFYPGYLCSLSPEELS

SVPPSSIWAVRPQDLDTCDPRQLDVLYPKARLAFQNMNGSEYFVKIQSFL

GGAPTEDLKALSQQNVSMDLATFMKLRTDAVLPLTVAEVQKLLGPHVEGL

KAEERHRPVRDWILRQRQDDLDTLGLGLQGGIPNGYLVLDLSMQEALSGT

PCLLGPGPVLTVLALLLASTLA

| | |
|---|---|
| Lengthy table referenced here<br>US11926672-20240312-T00001<br>Please refer to the end of the specification for access instructions. | Lengthy table referenced here<br>US11926672-20240312-T00007<br>Please refer to the end of the specification for access instructions. |
| Lengthy table referenced here<br>US11926672-20240312-T00002<br>Please refer to the end of the specification for access instructions. | Lengthy table referenced here<br>US11926672-20240312-T00008<br>Please refer to the end of the specification for access instructions. |
| Lengthy table referenced here<br>US11926672-20240312-T00003<br>Please refer to the end of the specification for access instructions. | Lengthy table referenced here<br>US11926672-20240312-T00009<br>Please refer to the end of the specification for access instructions. |
| Lengthy table referenced here<br>US11926672-20240312-T00004<br>Please refer to the end of the specification for access instructions. | Lengthy table referenced here<br>US11926672-20240312-T00010<br>Please refer to the end of the specification for access instructions. |
| Lengthy table referenced here<br>US11926672-20240312-T00005<br>Please refer to the end of the specification for access instructions. | Lengthy table referenced here<br>US11926672-20240312-T00011<br>Please refer to the end of the specification for access instructions. |
| Lengthy table referenced here<br>US11926672-20240312-T00006<br>Please refer to the end of the specification for access instructions. | Lengthy table referenced here<br>US11926672-20240312-T00012<br>Please refer to the end of the specification for access instructions. |

```
Kappa CL
                                                                                    (SEQ ID NO: 883)
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSS
PVTKSFNRGEC (SEQ ID NO: 926)
RTVAAPSVFIFPPSDEQLKSGTASVVCLLNNFYPREAKVQWKVDNALQSGNSQESVTEQDSKDSTYSLESTLTLSKADYEKHKVYACEVTHQGLSS
PVTKSFNRGEC (SEQ ID NO: 927)
RTVAAPSVFIFPPSDEQLKSGTASVVCLLNNFYPREAKVQWKVDNALQSGNSQESVTEQDSKDSTYSLKSTLTLSKADYEKHKVYACEVTHQGLSS
PVTKSFNRGEC Lambda CL
                                                                                    (SEQ ID NO: 884)
GQPKAAPSVTLFPPSSEELQANKATLVCLISDFYPGAVTVAWKADSSPVKAGVETTTPSKQSNNKYAASSYLSLTPEQWKSHRSYSCQVTHEGSTV
EKTVAPTECS
```

-continued (SEQ ID NO: 928)
GQPKAAPSVTLFPPSSEELQANKATLVCLISDFYPGAVTVAWKADSSPVKAGVETTTPSKQSNNKYAAKSYLSLTPEQWKSHRSYSCQVTHEGSTV
EKTVAPTECS (SEQ ID NO: 929)
GQPKAAPSVTLFPPSSEELQANKATLVCLISDFYPGAVTVAWKADSSPVKAGVETTTPSKQSNNKYAAESYLSLTPEQWKSHRSYSCQVTHEGSTV
EKTVAPTECS Common CH1-hinge-CH2-CH3

(SEQ ID NO: 885)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKK
VEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLH
QDWLNGKEYKCKVSNKALPAPIEKTISKAKGQPREPQVYTLPPSREEMTKNQVSLTCLVKGFYPSDIAVEWESNGQPENNYKTTPPVLDSDGSFFL
YSKLTVDKSRWQQGNVFSCSVMHEALHNHYTQKSLSLSPGK

Common CH1-hinge-CH2-CH3 (K590G)

(SEQ ID NO: 886)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKK
VEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLH
QDWLNGKEYKCKVSNKALPAPIEKTISKAKGQPREPQVYTLPPSREEMTKNQVSLTCLVKGFYPSDIAVEWESNGQPENNYKTTPPVLDSDGSFFL
YSKLTVDKSRWQQGNVFSCSVMHEALHNHYTQKSLSLSPGG (SEQ ID NO: 887)
GGSGGGGS (SEQ ID NO: 888)
GGGGSGGGGS (SEQ ID NO: 889)
GGGGSGGGGSGGGGS (SEQ ID NO: 890)
GGGGSGGGGSGGGGSGGGGS (SEQ ID NO: 891)
GGGGQGGGGQ (SEQ ID NO: 892)
GGGGQGGGGQGGGGQ (SEQ ID NO: 893)
GGGGQGGGGQGGGGQGGGGQ (SEQ ID NO: 894)
MDMRVPAQLLGLLLLWLRGARC (SEQ ID NO: 895)
MAWALLLLTLLTQGTGSWA (SEQ ID NO: 896)
MTCSPLLLTLLIHCTGSWA (SEQ ID NO: 897)
MEAPAQLLFLLLLWLPDTTG (SEQ ID NO: 898)
MEWTWRVLFLVAAATGAHS (SEQ ID NO: 899)
METPAQLLFLLLLWLPDTTG (SEQ ID NO: 900)
METPAQLLFLLLLWLPDTTG (SEQ ID NO: 901)
MKHLWFFLLLVAAPRWVLS

MEWSWVFLFFLSVTTGVHS

Human MSLNv2 NM 013404

(SEQ ID NO: 902)

(SEQ ID NO: 903)

MALPTARPLLGSCGTPALGSLLFLLFSLGWVQPSRTLAGETGQEAAPLDGVLANPPNISSLSPRQLLGFPCAEVSGLSTERVRELAVALAQKNVKLST

EQLRCLAHRLSEPPEDLDALPLDLLLFLNPDAFSGPQACTRFFSRITKANVDLLPRGAPERQRLLPAALACWGVRGSLLSEADVRALGGLACDLPGR

A-2428-US-NP

FVAESAEVLLPRLVSCPGPLDQDQQEAARAALQGGGPPYGPPSTWSVSTMDALRGLLPVLGQPIIRSIPQGIVAAWRQRSSRDPSWRQPERILRPRFR

REVEKTACPSGKKAREIDESLIFYKKWELEACVDAALLATQMDRVNAIPFTYEQLDVLKHKLDELYPQGYPESVIQHLGYLFLKMSPEDIRKWNVT

SLETLKALLEVNKGHEMSPQAPRRPLPQVATLIDRFVKGRGQLDKDTLDTLTAFYPGYLCSLSPEELSSVPPSSIWAVRPQDLDTCDPRQLDVLYPK

ARLAFQNMNGSEYFVKIQSFLGGAPTEDLKALSQQNVSMDLATFMKLRTDAVLPLTVAEVQKLLGPHVEGLKA

EERHRPVRDWILRQRQDDLDTLGLGLQGGIPNGYLVLDLSMQEALSGTPCLLGPGPVLTVALLLASTLA

Human MSLN v6 AY743922

(SEQ ID NO: 904)

MALPTARPLLGSCGTPALGSLLFLLFSLGWVQPSRTLAGETGQEAAPLDGVLANPPNISSLSPRQLLGFPCAEVSGLSTERVRELAVALAQKNVKLST

EQLRCLAHRLSEPPEDLDALPLDLLLFLNPDAFSGPQACTHFFSRITKANVDLLPRGAPERQRLLPAALACWGVRGSLLSEADVRALGGLACDLPGR

FVAESAEVLLPRLVSCPGPLDQDQQEAARAALQGGGPPYGPPSTWSVSTMDALRGLLPVLGQPIIRSIPQGIVAAWRQRSSRDPSWRQPERILRPRFR

REVEKTACPSGKKAREIDESLIFYKKWELEACVDAALLATQMDRVNAIPFTYEQLDVLKHKLDELYPQGYPESVIQHLGYLFLKMSPEDIRKWNVT

SLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNM

NGSEYFVKIQSFLGGAPTEDLKALSQQNVSMDLATFMKLRTDAVLPLTVAEVQKLLGPHVEGLKAEERHRPVR

DWILRQRQDDLDTLGLGLQGGIPNGYLVLDLSVQEALSGTPCLLGPGPVLTVALLLASTLA cyno MSLN macaque v1 LMR C52457

(SEQ ID NO: 905)

MALPMARPLSGSCGTPALGSLLFLLFSLGWVQPSRVLAGETRQEAAPLDGILTNAPDIASLSPRQLLGFTCVEVSGLSTELVQELAVALGQKNVKLS

AEQLRCLAHRLSEPPEDLDALPLDLLLFLNPDAFSGPQACTHFFSRVAKANVDLLPRGAPERQRLLPAALTCWGVRGSLLSEADVRALGGLACDLP

GRFVAESAEWLPRLVRCLGPLDQDQQEAARAALQRGGPPYGPPSTWSISTLDDLQSLLPVLGQPVIHSIPQGILAAWRQRSSRDPSWQQPEQTVLRP

RFRRDVERTTCPPEKEVHEIDENLIFYKKRELEACVDAALLAAQMDRVDAIPFTYEQLDVLKHKLDELYPQGYPESVIRHLGHLFLKMSPEDIRKWN

VTSLETLKALLKVSKGHEMSAQVATLIDRVWGRGQLDKDTADTLTAFCPGCLCSLSPERLSSVPPSVIGAVRPQDLDTCGPRQLDVLYPKARLAFQ

NMSGSEYFVKIRPFLGGAPTEDLKALSQQNVSMDLATFMKLRREAVLPLTVAEVQKLLGPHVEGLKVEEQHSPVRDWILKQRQDDLDTLGLGLQG

GIPNGYLILDLSVREALSGTPCLLGPGPVLTILALLLASTLA

Kappa CL S176E
A-2428-US-NP (SEQ ID NO: 906)

RTVAAPSVFIFPPSDEQLKSGTASVVCLLNNFYPREAKVQWKVDNALQSGNSQESVTEQDSKDSTYSL<u>E</u>STLTLSKADYEKHKVYACEVTHQGLSS

PVTKSFNRGEC

Kappa CL S176K (SEQ ID NO: 907)

RTVAAPSVFIFPPSDEQLKSGTASVVCLLNNFYPREAKVQWKVDNALQSGNSQESVTEQDSKDSTYSL<u>K</u>STLTLSKADYEKHKVYACEVTHQGLSS

PVTKSFNRGEC

Lambda CL S176K (SEQ ID NO: 908)

GQPKAAPSVTLFPPSSEELQANKATLVCLISDFYPGAVTVAWKADSSPVKAGVETTTPSKQSNNKYAA<u>K</u>SYLSLTPEQWKSHRSYSCQVTHEGSTV

EKTVAPTECS

Lambda CL S176E (SEQ ID NO: 909)

GQPKAAPSVTLFPPSSEELQANKATLVCLISDFYPGAVTVAWKADSSPVKAGVETTTPSKQSNNKYAA<u>E</u>SYLSLTPEQWKSHRSYSCQVTHEGSTV

EKTVAPTECS

-continued

\>XM_005590816.2 (without N-terminal 11 aa) cyno Mesothelin (SEQ ID NO: 910)

MALPMARPLSGSCGTPALGSLLFLLFSLGWVQPSRVLAGETRQEAAPLDGILTNAPDIASLSPRQLLGFTCVEVSGLSTELVQELAVALGQKNVKLS

AEQLRCLAHRLSEPPEDLDALPLDLLLFLNPDAFSGPQACTHFFSRVAKANVDLLPRGAPERQRLLPAALTCWGVRGSLLSEADVRALGGLACDLP

GRFVAESAEVVLPRLVRCLGPLDQDQQEAARAALQRGGPPYGPPSTWSISTLDDLQSLLPVLGQPVIHSIPQGILAAWRQRSSRDPSWQQPEQTVLR

PRFRRDVERTTCPPEKEVHEIDESLIFYKKRELEACVDAALLAAQMDRVDAIPFTYEQLDVLKHKLDELYPQGYPESVIRHLGHLFLKMSPEDIRKW

A-2428-US-NP
NVTSLETLKALLKVSKGHEMSAQVATLIDRVVVGRGQLDKDTADTLTAFCPGCLCSLSPERLSSVPPSIIGAVRPQDLDTCGPRQLDVLYPKARLAF

QNMSGSEYFVKIRPFLGGAPTEDLKALSQQNVSMDLATFMKLRREAVLPLSVAEVQKLLGPHVEGLKVEEQHSPVRDWILKQRQDDLDTLGLGLQ

GGIPNGYLILDLSVREALSGTPCLLGPGPVLTVLALLLASTLA

\>XP_005569274.1 PREDICTED: tumor necrosis factor receptor superfamily member 5 isoform X1
[Macaca fascicularis]

(SEQ ID NO: 911)

MVRLPLQCVLWGCLLTAVYPEPPTACREKQYLINSQCCSLCQPGQKLVSDCTEFTETECLPCGESEFLDTWNRETRCHQHKYCDPNLGLRVQQKGT

SETDTICTCEEGLHCTSESCESCVPHRSCLPGFGVKQIATGVSDTICEPCPVGFFSNVSSAFEKCRPWTSCETKDLVVQQAGTNKTDVVCGPQDRQRA

LVVIPICLGILFVILLLVLVFISESSEKVAKKPNDKVPHPKQEPQEINFPDDLPGSNPAAPVQETLHGCQPVTQEDGKESRISVQERQ

Common CH1-hinge-CH2-CH3 (S176K)

(SEQ ID NO: 912)

ASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKK

VEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLH

QDWLNGKEYKCKVSNKALPAPIEKTISKAKGQPREPQVYTLPPSREEMTKNQVSLTCLVKGFYPSDIAVEWESNGQPENNYKTTPPVLDSDGSFFL

YSKLTVDKSRWQQGNVFSCSVMHEALHNHYTQKSLSLSPGG

Common CH1-hinge-CH2-CH3 (S176E)

(SEQ ID NO: 913)

ASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKK

VEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLH

A-2428-US-NP
QDWLNGKEYKCKVSNKALPAPIEKTISKAKGQPREPQVYTLPPSREEMTKNQVSLTCLVKGFYPSDIAVEWESNGQPENNYKTTPPVLDSDGSFFL

YSKLTVDKSRWQQGNVFSCSVMHEALHNHYTQKSLSLSPGG

Common CH1-hinge-CH2-CH3 (S176K/K590G)

(SEQ ID NO: 914)

ASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKK

VEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLH

QDWLNGKEYKCKVSNKALPAPIEKTISKAKGQPREPQVYTLPPSREEMTKNQVSLTCLVKGFYPSDIAVEWESNGQPENNYKTTPPVLDSDGSFFL

YSKLTVDKSRWQQGNVFSCSVMHEALHNHYTQKSLSLSPGK

Common CH1-hinge-CH2-CH3 (S176E/K590G)

(SEQ ID NO: 915)

ASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKK

VEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLH

QDWLNGKEYKCKVSNKALPAPIEKTISKAKGQPREPQVYTLPPSREEMTKNQVSLTCLVKGFYPSDIAVEWESNGQPENNYKTTPPVLDSDGSFFL

YSKLTVDKSRWQQGNVFSCSVMHEALHNHYTQKSLSLSPGK

LENGTHY TABLES

The patent contains a lengthy table section. A copy of the table is available in electronic form from the USPTO web site (https://seqdata.uspto.gov/?pageRequest=docDetail&DocID=US11926672B2). An electronic copy of the table will also be available from the USPTO upon request and payment of the fee set forth in 37 CFR 1.19(b)(3).

SEQUENCE LISTING (929 sequences)

SEQ ID NO: 1 - protein, 277 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 2 - protein, 622 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 3 - DNA, 348 bp, Artificial Sequence
  Description of Artificial Sequence: Synthetic polynucleotide
caggctgtgccgactcagccctcttccctctctgcatctcctggagcatcagccagtctcacctgcaccttacgcagtggcatcaatgttggttcctccaggatatattggtaccagcagaagccagggagtcctccccagtttctcctgaggtacacatcagactcagataaattgcagggctctggagtccccagccgcttctctggatccaaagatgcttcggccaatgcaggacttttactcatctctgggctccagtctgaggatgaggctgactattactgtatgatttggcacagcagcgctgtggtattcggcggagggaccaaactgaccgtcctaggt

SEQ ID NO: 4 - DNA, 375 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagccatggcatgcactgggtccgccaacctccaggcaaggggctggagtgggtggcagttatctggtatgatggaagtaatgaatactatggagactccgtgaagggccgattcaccatctccagagacaattccaagaacacgctgtatctgcaaatgaacagcctgagagtcgaggacacggctgtgtattactgtacgagaggggggggccactggaactacgagggccactactatggtatggacgtctggggccaagggaccacggtcaccgtctcctca

SEQ ID NO: 5 - protein, 116 aa, Artificial Sequence
  Description of Artificial Sequence: Synthetic polypeptide
QAVPTQPSSLSASPGASASLTCTLRSGINVGSSRIYWYQQKPGSPPQFLLRYTSDSDKLQGSGVPSRFSGSKDASANAGLLLISGLQSEDEADYYCMIWHSSAVVFGGGTKLTVLG

SEQ ID NO: 6 - protein, 125 aa, Artificial Sequence
  Description of Artificial Sequence: Synthetic polypeptide
QVQLVESGGGVVQPGRSLRLSCAASGFTFSSHGMHWVRQPPGKGLEWVAVIWYDGSNEYYGDSVKGRFTISRDNSKNTLYLQMNSLRVEDTAVYYCTRGGGHWNYEGHYYGMDVWGQGTTVTVSS

SEQ ID NO: 7 - DNA, 327 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagcaactacttagcctggtaccaacagaaacctggccaggctcccagggcccttatctatgctgcatccaacagggccgctggcatctcagacaggttcagtggcagtgggtctgggacagacttcactctcaccatcagcagactggagcctgaagattttgcagtgtatttctgtcagcagtatggtagctcaccgctcactttcggcggagggactaaggtggagatcaaacga

SEQ ID NO: 8 - DNA, 357 bp, Artificial Sequence
  Description of Artificial Sequence: Synthetic polynucleotide
caggtacagctgcaacagtcaggtccaggactggtgaagccctcgcagaccctctcactcacctgtgccatctccggggacagtgtctctagcagccgtactgcttggaactggatcaggcagtccccatcgagaggccttgagtggctgggaaggacatactacaggtccaagtggtatcatgattattcagtatctgtgaaaagtcgaataaccatcgacccagacacatccaagaaccagttctccctgcagctgaactctgtgactcccgaggacacggctgtttattattgtgcaagaggggctgctccctttgactactggggccagggaaccctggtcaccgtctcctca

SEQ ID NO: 9 - protein, 109 aa, Artificial Sequence
  Description of Artificial Sequence: Synthetic polypeptide
EIVLTQSPGTLSLSPGERATLSCRASQSVSSNYLAWYQQKPGQAPRALIYAASNRAAGISDRFSGSGSGTDFTLTISRLEPEDFAVYFCQQYGSSPLTFGGGTKVEIKR

SEQ ID NO: 10 - protein, 119 aa, Artificial Sequence
  Description of Artificial Sequence: Synthetic polypeptide
QVQLQQSGPGLVKPSQTLSLTCAISGDSVSSSRTAWNWIRQSPSRGLEWLGRTYYRSKWYHDYSVSVKSRITIDPDTSKNQFSLQLNSVTPEDTAVYYCARGAAPFDYWGQGTLVTVSS

SEQ ID NO: 11 - DNA, 324 bp, Artificial Sequence
  Description of Artificial Sequence: Synthetic polynucleotide
gacatccagatgacccagtctccatcctcactgtctgcatctgtaggagacagagtcaccatcacctgtcgggcgagtcaggacattagcaataatttagcctggtttcagcagaaaccagggaaaccccctaagtccctgatgtatgctgcatccagtttgcacagtggagtcccatcaacgttcagcggcagtggatctgggacagatttcactttcaccatcagcagcctgcagcctgaagattttgcaacttattactgccaacagtataatagttaccctctcactttcggcggagggaccaaggtggagatcagacga

SEQ ID NO: 12 - DNA, 375 bp, Artificial Sequence
  Description of Artificial Sequence: Synthetic polynucleotide
caggtgcaactggtgcagtctggggctgaggtgacgaagcctggggcctcagtgaaggtctcctgcaaggcttctggatacaccttcgccggctactatatgcactgggtgcgacaggcccctggacaagggcttgagtggatgggatggatcaaccctcacagtggtggcacaaactatgcacagaagtttcaggacagggtcaccatgaccagggacacgtccatcaacacagcctacatggaactgagcaggctgagatctgacgacacggccgtgtattactgtgcgagagaacgtatttctatggttcggggagtcgggcacaactggttcgccccctggggccagggaaccctggtcaccgtctcctca

SEQ ID NO: 13 - protein, 108 aa, Artificial Sequence
  Description of Artificial Sequence: Synthetic polypeptide
DIQMTQSPSSLSASVGDRVTITCRASQDISNNLAWFQQKPGKPPKSLMYAASSLHSGVPSTFSGSGSGTDFTFTISSLQPEDFATYYCQQYNSYPLTFGGGTKVEIRR

SEQ ID NO: 14 - protein, 125 aa, Artificial Sequence
  Description of Artificial Sequence: Synthetic polypeptide
QVQLVQSGAEVTKPGASVKVSCKASGYTFAGYYMHWVRQAPGQGLEWMGWINPHSGGTNYAQKFQDRVTMTRDTSINTAYMELSRLRSDDTAVYYCARERISMVRGVGHNWFAPWGQGTLVTVSS

SEQ ID NO: 15 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctctgctgcattcagtttgcaaagtggggtcccatcaaggttcagcgtcagtggatctgggacagaattcactctcacaatcagcagcctgcagcctgaagattttgcaacttattactgtctacagtataatagttacccgtggacgttcggccaagggaccaaggtggaaatcaaacga

SEQ ID NO: 16 - DNA, 363 bp, Artificial Sequence
  Description of Artificial Sequence: Synthetic polynucleotide
caggtgcagctggtgcagtccgggactgaaatgaagaagcctggggcctcaatgaaggtctcctgccagacttctggatacaccttcatcgcctactatatacactgggtgcgacaggcccctggacaaggacttgagtggatgggatggctcaaccctgacagtggtggcacaaactttgccccgaggtttcaggacagagtcaccatgaccagggacacgtccatcaccacagcctacatggaactgagcagcctgagatctgacgacacggccgtgtattactgtgcgagagagaagtttaactacaactatggtgcttttgatatctggggccaagggacaatggtcaccgtctcttca

SEQ ID NO: 17 - protein, 108 aa, Artificial Sequence
  Description of Artificial Sequence: Synthetic polypeptide
DIQMTQSPSSLSASVGDRVTITCRASQGIRNDLGWYQQKPGKAPKRLISAAFSLQSGVPSRFSVSGSGTEFTLTISSLQPEDFATYYCLQYNSYPWTFGQGTKVEIKR

SEQ ID NO: 18 - protein, 121 aa, Artificial Sequence
  Description of Artificial Sequence: Synthetic polypeptide
QVQLVQSGTEMKKPGASMKVSCQTSGYTFIAYYIHWVRQAPGQGLEWMGWLNPDSGGTNFAPRFQDRVTMTRDTSITTAYMELSSLRSDDTAVYYCAREKFNYNYGAFDIWGQGTMVTVSS

SEQ ID NO: 19 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgagttaggctggtatcagcagaaaccagggaaagcccctaagcgcctgatctatgctgcatccagtttggacagtggggtcccatcaaggttcagcggcagtagatctgggtcagaattcactctcacaatcagcagcctgcagcctgaagattttgcaacttattactgtctacaatatagtgggtcccctctcactttcggcggagggaccaaggtggagatcaaacga

SEQ ID NO: 20 - DNA, 378 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcaccgactactatatacactgggtgcgacaggcccctggacaagggcttgagtggatgggttggatcaaccctaacagtggtgacacaagctatgcacagaagtttcaggacagggtcaccgtgaccagggacacgtccatcaacacagcctacatggagctgagtaggctgaaatctgacgacacggccgtgtattactgtgcgagagaggtggggggctatggttcggggacctaccgctattacggtatggacgtctggggccaagggaccacggtcaccgtctcctca

SEQ ID NO: 21 - protein, 108 aa, Artificial Sequence
  Description of Artificial Sequence: Synthetic polypeptide
DIQMTQSPSSLSASVGDRVTITCRASQGIRNELGWYQQKPGKAPKRLIYAASSLDSGVPSRFSGSRSGSEFTLTISSLQPEDFATYYCLQYSGSPLTFGGGTKVEIKR

SEQ ID NO: 22 - protein, 126 aa, Artificial Sequence
  Description of Artificial Sequence: Synthetic polypeptide
QVQLVQSGAEVKKPGASVKVSCKASGYTFTDYYIHWVRQAPGQGLEWMGWINPNSGDTSYAQKFQDRVTVTRDTSINTAYMELSRLKSDDTAVYYCAREVGGYGSGTYRYYGMDVWGQGTTVTVSS

SEQ ID NO: 23 - DNA, 324 bp, Artificial Sequence
  Description of Artificial Sequence: Synthetic polynucleotide
gacatccagatgacccagtctccatcctccctgtctgcatctgtaggagacagaatcaccatcacttgccgggcaagtcaggacattagaaatgatttaggctggtatcagcagaaaccagggaaagcccctaagcgcctgatctttggtgcatccaatttgcaaagtggggtcccatcaaggttcagcggcagtagatctgggacagaattcactctcacaatcagcagcctgcagcctgaagattttgcaacatattattgtctacaacataatattgctccgctcaccttcggcggagggaccaaggtggagagcaaacga

SEQ ID NO: 24 - DNA, 378 bp, Artificial Sequence
  Description of Artificial Sequence: Synthetic polynucleotide
caggtgcagctggtgcagtctggggctgaggtgaagaagcctggggcctcagtgaaggtctcctgtaaggcttctggatacaccttcaccgactactatattcactgggtgcgacaggcccctggacaagtacttgagtggatgggatggatcaaccctaacagtggcggcacaaactatgcacagaagtttcagggcagggtcaccatgaccagggacacgtccatcaatacagcctacatggaggtgagcaggctgagatctgacgacacggccgtgtattactgtgcgagagaagatggggcagcagttggtcccctctactactactacggtatggacgtctggggccaagggaccacggtcaccgtctcctca

SEQ ID NO: 25 - protein, 108 aa, Artificial Sequence
  Description of Artificial Sequence: Synthetic polypeptide
DIQMTQSPSSLSASVGDRITITCRASQDIRNDLGWYQQKPGKAPKRLIFGASNLQSGVPSRFSGSRSGTEFTLTISSLQPEDFATYYCLQHNIAPLTFGGGTKVESKR

SEQ ID NO: 26 - protein, 126 aa, Artificial Sequence
  Description of Artificial Sequence: Synthetic polypeptide
QVQLVQSGAEVKKPGASVKVSCKASGYTFTDYYIHWVRQAPGQVLEWMGWINPNSGGTNYAQKFQGRVTMTRDTSINTAYMEVSRLRSDDTAVYYCAREDGAAVGPLYYYYGMDVWGQGTTVTVSS

SEQ ID NO: 27 - DNA, 321 bp, Artificial Sequence
  Description of Artificial Sequence: Synthetic polynucleotide
tcctatgagctgactcagccaccctcagtgtccgtgtccccaggacagacagccagcatcacctgctctggagaaaggttgggaaataaatatatttgctggtatcagcagaagccaggccagtcccctgttctggtcatctatcaagatttcaagcggccctcagggatccctgagcgattctctggctccaactctgggatcacagccactctgaccatcagcgggacccaggctatggatgaggctgactattactgtcaggcgtgggacagcagaactgtggtattcggcggagggaccaagctgaccgtcctaggt

SEQ ID NO: 28 - DNA, 363 bp, Artificial Sequence
  Description of Artificial Sequence: Synthetic polynucleotide
caggtgcagttggtggagtctgggggaggcttagtcaagcctggagggtccctgagactctcctgtgcagcctctgaattcaccttcagtgactactacatgagctggatccgccaggctccagggaaggggctggagtgggtttcatatattagtcgaagtggtgataccatatactacgcagactctgtgaagggccgattcaccatctccagggacaacgccaagaactcactgtatctgcaaatgaatggcctgcgagccgaagacacggccgtgtattactgtgcgagagacttagcagcaggtgctacagggggccttgactgctggggccagggaaccctggtcaccgtctcctca

SEQ ID NO: 29 - protein, 107 aa, Artificial Sequence
  Description of Artificial Sequence: Synthetic polypeptide
SYELTQPPSVSVSPGQTASITCSGERLGNKYICWYQQKPGQSPVLVIYQDFKRPSGIPERFSGSNSGITATLTISGTQAMDEADYYCQAWDSRTVVFGGGTKLTVLG

SEQ ID NO: 30 - protein, 121 aa, Artificial Sequence
  Description of Artificial Sequence: Synthetic polypeptide
QVQLVESGGGLVKPGGSLRLSCAASEFTFSDYYMSWIRQAPGKGLEWVSYISRSGDTIYYADSVKGRFTISRDNAKNSLYLQMNGLRAEDTAVYYCARDLAAGATGGLDCWGQGTLVTVSS

SEQ ID NO: 31 - DNA, 336 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgatgttgggaattataaccttgtctcctggtaccaacagcacccaggcaaagcccccaaactcatgatttttgaggtcaatcagcggccctcaggggtttctaatcgcttctctggctccaagtctggcaccacggcctccctgacaatctctgggctccaggctgcggacgaggctgattatttctgctgctcatatacaactagtagcacttatgtgatattcggcggagggaccaagctgaccgtcctaggt

SEQ ID NO: 32 - DNA, 360 bp, Artificial Sequence
  Description of Artificial Sequence: Synthetic polynucleotide
gaggtgcagctgctggagtctgggggaggcttggtacagcctggggggtccctgagactctcctgtgcagcctctggattcacctttagtagaaatgccatgagttgggtccgccaggctccagggaaggggctggagtgggtctcagctactggtggtagtggtattagcacatactacgcagactccgtgaagggccggttcaccatctccagagacaattccaagaacacgctgtatctgcaaatgaacagtctgagagccgaggacacggccgtatattactgtgcgagaggttatagcaacagctggtggtactttgactactggggccagggaaccctggtcaccgtctcctca

SEQ ID NO: 33 - protein, 112 aa, Artificial Sequence
  Description of Artificial Sequence: Synthetic polypeptide
QSALTQPASVSGSPGQSITISCTGTSSDVGNYNLVSWYQQHPGKAPKLMIFEVNQRPSGVSNRFSGSKSGTTASLTISGLQAADEADYFCCSYTTSSTYVIFGGGTKLTVLG

SEQ ID NO: 34 - protein, 120 aa, Artificial Sequence
  Description of Artificial Sequence: Synthetic polypeptide
EVQLLESGGGLVQPGGSLRLSCAASGFTFSRNAMSWVRQAPGKGLEWVSATGGSGISTYYADSVKGRFTISRDNSKNTLYLQMNSLRAEDTAVYYCARGYSNSWWYFDYWGQGTLVTVSS

SEQ ID NO: 35 - DNA, 333 bp, Artificial Sequence
  Description of Artificial Sequence: Synthetic polynucleotide
cagtctgccctgactcagcctcgctcagtgtccgggtctcctggacagtcagtcaccatctcctgcactggaaccagcagtgatgttggtggttatatctttgtctcctggtaccaacaacacccaggcaaagcccccaaactcatgatttatgatgtcagtaagcggccctctggggtccctgatcgcttctctggctccaagtctgtcaacacggcctccctgaccatctctgggctccaggctgaggatgagactgattattactgctgctcatatgcaggcaactacacttatgtcttcggaactgggaccaaggtcaccgtcctaggt

SEQ ID NO: 36 - DNA, 357 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccctcagtagctatggcatgcactgggtccgccaggctccaggcaaggggctggagtgggtggcagttatatggtatgatggaagtaataaatactatgcagactccgtgaagggccgagtcaccatctccagagacaattccaagaacacgctgtatctgcaaatgaatagcctgagagccgaggacacggctgtgtattactgtacgagagatggccggaactacgtctactttgacaactggggccagggaaccctggtcaccgtctcctca

SEQ ID NO: 37 - protein, 111 aa, Artificial Sequence
  Description of Artificial Sequence: Synthetic polypeptide
QSALTQPRSVSGSPGQSVTISCTGTSSDVGGYIFVSWYQQHPGKAPKLMIYDVSKRPSGVPDRFSGSKSVNTASLTISGLQAEDETDYYCCSYAGNYTYVFGTGTKVTVLG

SEQ ID NO: 38 - protein, 119 aa, Artificial Sequence
  Description of Artificial Sequence: Synthetic polypeptide
QVQLVESGGGVVQPGRSLRLSCAASGFTLSSYGMHWVRQAPGKGLEWVAVIWYDGSNKYYADSVKGRVTISRDNSKNTLYLQMNSLRAEDTAVYYCTRDGRNYVYFDNWGQGTLVTVSS

SEQ ID NO: 39 - DNA, 336 bp, Artificial Sequence
  Description of Artificial Sequence: Synthetic polynucleotide
cagtctgccctgactcagcctgcctccgtgtctgggtctcctggacagtcgatcaccatctcctgcactggaaccagcagtgatgttgggaattataaccttgtctcctggtaccaacagcacccaggcaaagcccccaaactcatgatttatgaggtcaataggcggccctcaggggtttctaatcgcttctctggctccaagtctggcaacacggcctccctgacaatctctgggctccaggctgaggacgaggctgaatattactgctgctcatatgcaggtagagacactttcgtggtgttcggcggagggaccaagctgaccgtcctaggt

SEQ ID NO: 40 - DNA, 363 bp, Artificial Sequence
  Description of Artificial Sequence: Synthetic polynucleotide
caggtgcagctggtgcagtctgggactgaggtgaagaagcctggggcctcagtgaaggtctcctgcaaggcttctggatacaccttccccggctactatatgcactgggtgcgacaggcccctggacaggggcttgagtggatgggatggatcaaccctgacagtggtggcacaaagtatacacagaagtttcagggcagggtcaccttgaccagggacgcgtccgtcagcacagcctacattgacctgaacaggctgagatctgacgacacggccgtatattactgtgcgagagagaggtgtaggactaccaactgctatttggactactggggccagggaagtctggtcaccgtctcctca

SEQ ID NO: 41 - protein, 112 aa, Artificial Sequence
  Description of Artificial Sequence: Synthetic polypeptide
QSALTQPASVSGSPGQSITISCTGTSSDVGNYNLVSWYQQHPGKAPKLMIYEVNRRPSGVSNRFSGSKSGNTASLTISGLQAEDEAEYYCCSYAGRDTFVVFGGGTKLTVLG

SEQ ID NO: 42 - protein, 121 aa, Artificial Sequence
  Description of Artificial Sequence: Synthetic polypeptide
QVQLVQSGTEVKKPGASVKVSCKASGYTFPGYYMHWVRQAPGQGLEWMGWINPDSGGTKYTQKFQGRVTLTRDASVSTAYIDLNRLRSDDTAVYYCARERCRTTNCYLDYWGQGSLVTVSS

SEQ ID NO: 43 - DNA, 324 bp, Artificial Sequence
  Description of Artificial Sequence: Synthetic polynucleotide
gacatccagatgacccagtctccatcctccctgtctgcatctgtaggagacattctcaccatcacttgccgggcaagtcagaacattaccacctatttaaattggtatcagcagaaaccagggaaagcccctaacctcctgatctctgctgcatcccgtttgcgaagtggggtcccatcaaggttcagtggcagtggatctgggacagatttcactctcaccatcagcagtctgcaacctgtagattttacaactttctactgtcaacagactttcactaccccgtggacgttcggccaagggaccaaggtggagatcaaacga

SEQ ID NO: 44 - DNA, 363 bp, Artificial Sequence
  Description of Artificial Sequence: Synthetic polynucleotide
caggtgcagctggtgcagtctggggctgaggtgaagaagcctggggcctcagtgaaggtctcctgcaaggcttctggatacaccttcgccggctactatatgcactgggtgcgacaggcccctggacaagggcttgagtggatgggatggatcaaccctgacagtggaggcacaaactttgcacagcagtttcagggcagggtcaccatgaccagggatacgtccatcagcacagcctacatggaggtgagcaggctgagatctgacgacacggccgtgttttactgtgcgagagagaagataactatgactggtatttactttgactattggggccagggaaccctggtcaccgtctcctca

SEQ ID NO: 45 - protein, 108 aa, Artificial Sequence
  Description of Artificial Sequence: Synthetic polypeptide
DIQMTQSPSSLSASVGDILTITCRASQNITTYLNWYQQKPGKAPNLLISAASRLRSGVPSRFSGSGSGTDFTLTISSLQPVDFTTFYCQQTFTTPWTFGQGTKVEIKR

SEQ ID NO: 46 - protein, 121 aa, Artificial Sequence
  Description of Artificial Sequence: Synthetic polypeptide
QVQLVQSGAEVKKPGASVKVSCKASGYTFAGYYMHWVRQAPGQGLEWMGWINPDSGGTNFAQQFQGRVTMTRDTSISTAYMEVSRLRSDDTAVFYCAREKITMTGIYFDYWGQGTLVTVSS

SEQ ID NO: 47 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatcctgcatccagtttacaaagtggggtcccatcaaggttcagcggcagtggatctgggacagaattcactctcacaatcagcagcctgcagcctgaagattttgcaacttattactgtctacagcataatagttaccctctcactttcggcggagggaccaaggtggagatcaagcga

SEQ ID NO: 48 - DNA, 378 bp, Artificial Sequence
  Description of Artificial Sequence: Synthetic polynucleotide
caggtgcagctggtgcagtctggggctgaggtgaagaagtctggggcctcagtgaaggtctcctgcaaggcttctggatacaccttcgccggctactatatacactgggtgcgacaggcccctggacaagggcttgagtggatgggatggatcaaccctgacagtggtgacacaaactatgcacagaagtttcagggcagggtcaccatgaccagggacacgtccatcagtacagcctacatggagctgagcaggctgagatctgacgacacggccgtgtattactgtgcgagagagaggttaacacattgtggtggtgactgctattcccaatggttcgacccctggggccagggaaccctggtcaccgtctcctca

SEQ ID NO: 49 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYPASSLQSGVPSRFSGSGSGTEFTLTISSLQPEDFATYYCLQHNSYPLTFGGGTKVEIKR

SEQ ID NO: 50 - protein, 126 aa, Artificial Sequence
  Description of Artificial Sequence: Synthetic polypeptide
QVQLVQSGAEVKKSGASVKVSCKASGYTFAGYYIHWVRQAPGQGLEWMGWINPDSGDTNYAQKFQGRVTMTRDTSISTAYMELSRLRSDDTAVYYCARERLTHCGGDCYSQWFDPWGQGTLVTVSS

SEQ ID NO: 51 - DNA, 324 bp, Artificial Sequence
  Description of Artificial Sequence: Synthetic polynucleotide
gacatccagatgacccagtctccatcctccctgtctgcatctgtaggagacagagtcaccatcacttgccgggcaggtcagaacattagcaggcatttaaattggtatcagcagaatccagggaaagcccctaaggtcctgatccatcctgcatccagtttgccaagtggggtcccgtcaaggttcagtggcagtggatctgggacagatttcagtcttaccatcagcagtctgcaacctgaagattttggaacttacttctgtcaacagagttacagtacccctcccactttcggcggagggaccaaggtggagctcaaacga

SEQ ID NO: 52 - DNA, 375 bp, Artificial Sequence
  Description of Artificial Sequence: Synthetic polynucleotide
caggtgcaactggtgcagtctggggctgaagtgaagaagcctggggcctcagtgaaggtctcctgcaaggcttctggatacaccttccccggctactatatgtactggttgcgacaggcccctggacaaggacttgagtggatgggatggatcaaccctgacagtggtgacacaaactatgcacagaagtttcagggcagggtcaccatgaccagggacacgtccatcagcacagcctttatggagctgagcaggctgagatcagacgacacggccgtgtattactgtgcgagagagaagcccagatattttgactccttctactactaccttatggacgtctggggccaagggaccacggtcaccgtctcctca

SEQ ID NO: 53 - protein, 108 aa, Artificial Sequence
  Description of Artificial Sequence: Synthetic polypeptide
DIQMTQSPSSLSASVGDRVTITCRAGQNISRHLNWYQQNPGKAPKVLIHPASSLPSGVPSRFSGSGSGTDFSLTISSLQPEDFGTYFCQQSYSTPPTFGGGTKVELKR

SEQ ID NO: 54 - protein, 125 aa, Artificial Sequence
  Description of Artificial Sequence: Synthetic polypeptide
QVQLVQSGAEVKKPGASVKVSCKASGYTFPGYYMYWLRQAPGQGLEWMGWINPDSGDTNYAQKFQGRVTMTRDTSISTAFMELSRLRSDDTAVYYCAREKPRYFDSFYYYLMDVWGQGTTVTVSS

SEQ ID NO: 55 - DNA, 42 bp, Artificial Sequence
  Description of Artificial Sequence: Synthetic oligonucleotide
accttacgcagtggcatcaatgttggttcctccaggatatat

SEQ ID NO: 56 - DNA, 33 bp, Artificial Sequence
  Description of Artificial Sequence: Synthetic oligonucleotide
tacacatcagactcagataaattgcagggctct

SEQ ID NO: 57 - DNA, 27 bp, Artificial Sequence
  Description of Artificial Sequence: Synthetic oligonucleotide
atgatttggcacagcagcgctgtggta

SEQ ID NO: 58 - protein, 14 aa, Artificial Sequence
  Description of Artificial Sequence: Synthetic peptide
TLRSGINVGSSRIY

SEQ ID NO: 59 - protein, 11 aa, Artificial Sequence
  Description of Artificial Sequence: Synthetic peptide
YTSDSDKLQGS

SEQ ID NO: 60 - protein, 9 aa, Artificial Sequence
  Description of Artificial Sequence: Synthetic peptide
MIWHSSAVV

SEQ ID NO: 61 - DNA, 36 bp, Artificial Sequence
  Description of Artificial Sequence: Synthetic oligonucleotide
agggccagtcagagtgttagcagcaactacttagcc

SEQ ID NO: 62 - DNA, 21 bp, Artificial Sequence
  Description of Artificial Sequence: Synthetic oligonucleotide
gctgcatccaacagggccgct

SEQ ID NO: 63 - DNA, 27 bp, Artificial Sequence
  Description of Artificial Sequence: Synthetic oligonucleotide
cagcagtatggtagctcaccgctcact

SEQ ID NO: 64 - protein, 12 aa, Artificial Sequence
  Description of Artificial Sequence: Synthetic peptide
RASQSVSSNYLA

SEQ ID NO: 65 - protein, 7 aa, Artificial Sequence
  Description of Artificial Sequence: Synthetic peptide
AASNRAA

SEQ ID NO: 66 - protein, 9 aa, Artificial Sequence
  Description of Artificial Sequence: Synthetic peptide
QQYGSSPLT

SEQ ID NO: 67 - DNA, 33 bp, Artificial Sequence
  Description of Artificial Sequence: Synthetic oligonucleotide
cgggcgagtcaggacattagcaataatttagcc

SEQ ID NO: 68 - DNA, 21 bp, Artificial Sequence
  Description of Artificial Sequence: Synthetic oligonucleotide
gctgcatccagtttgcacagt

SEQ ID NO: 69 - DNA, 27 bp, Artificial Sequence
  Description of Artificial Sequence: Synthetic oligonucleotide
caacagtataatagttaccctctcact

SEQ ID NO: 70 - protein, 11 aa, Artificial Sequence
  Description of Artificial Sequence: Synthetic peptide
RASQDISNNLA

SEQ ID NO: 71 - protein, 7 aa, Artificial Sequence
  Description of Artificial Sequence: Synthetic peptide
AASSLHS

SEQ ID NO: 72 - protein, 9 aa, Artificial Sequence
  Description of Artificial Sequence: Synthetic peptide
QQYNSYPLT

SEQ ID NO: 73 - DNA, 33 bp, Artificial Sequence
  Description of Artificial Sequence: Synthetic oligonucleotide
cgggcaagtcagggcattagaaatgatttaggc

SEQ ID NO: 74 - DNA, 21 bp, Artificial Sequence
  Description of Artificial Sequence: Synthetic oligonucleotide
gctgcattcagtttgcaaagt

SEQ ID NO: 75 - DNA, 27 bp, Artificial Sequence
  Description of Artificial Sequence: Synthetic oligonucleotide
ctacagtataatagttacccgtggacg

SEQ ID NO: 76 - protein, 11 aa, Artificial Sequence
  Description of Artificial Sequence: Synthetic peptide
RASQGIRNDLG

SEQ ID NO: 77 - protein, 7 aa, Artificial Sequence
  Description of Artificial Sequence: Synthetic peptide
AAFSLQS

SEQ ID NO: 78 - protein, 9 aa, Artificial Sequence
  Description of Artificial Sequence: Synthetic peptide
LQYNSYPWT

SEQ ID NO: 79 - DNA, 33 bp, Artificial Sequence
  Description of Artificial Sequence: Synthetic oligonucleotide
cgggcaagtcagggcattagaaatgagttaggc

SEQ ID NO: 80 - DNA, 21 bp, Artificial Sequence
  Description of Artificial Sequence: Synthetic oligonucleotide
gctgcatccagtttggacagt

SEQ ID NO: 81 - DNA, 27 bp, Artificial Sequence
  Description of Artificial Sequence: Synthetic oligonucleotide
ctacaatatagtgggtcccctctcact

SEQ ID NO: 82 - protein, 11 aa, Artificial Sequence
  Description of Artificial Sequence: Synthetic peptide
RASQGIRNELG

SEQ ID NO: 83 - protein, 7 aa, Artificial Sequence
  Description of Artificial Sequence: Synthetic peptide
AASSLDS

SEQ ID NO: 84 - protein, 9 aa, Artificial Sequence
  Description of Artificial Sequence: Synthetic peptide
LQYSGSPLT

SEQ ID NO: 85 - DNA, 33 bp, Artificial Sequence
  Description of Artificial Sequence: Synthetic oligonucleotide
cgggcaagtcaggacattagaaatgatttaggc

SEQ ID NO: 86 - DNA, 21 bp, Artificial Sequence
  Description of Artificial Sequence: Synthetic oligonucleotide
ggtgcatccaatttgcaaagt

SEQ ID NO: 87 - DNA, 27 bp, Artificial Sequence
  Description of Artificial Sequence: Synthetic oligonucleotide
ctacaacataatattgctccgctcacc

SEQ ID NO: 88 - protein, 11 aa, Artificial Sequence
  Description of Artificial Sequence: Synthetic peptide
RASQDIRNDLG

SEQ ID NO: 89 - protein, 7 aa, Artificial Sequence
  Description of Artificial Sequence: Synthetic peptide
GASNLQS

SEQ ID NO: 90 - protein, 9 aa, Artificial Sequence
  Description of Artificial Sequence: Synthetic peptide
LQHNIAPLT

SEQ ID NO: 91 - DNA, 33 bp, Artificial Sequence
  Description of Artificial Sequence: Synthetic oligonucleotide
tctggagaaaggttgggaaataaatatatttgc

SEQ ID NO: 92 - DNA, 21 bp, Artificial Sequence
  Description of Artificial Sequence: Synthetic oligonucleotide
caagatttcaagcggccctca

SEQ ID NO: 93 - DNA, 27 bp, Artificial Sequence
  Description of Artificial Sequence: Synthetic oligonucleotide
caggcgtgggacagcagaactgtggta

SEQ ID NO: 94 - protein, 11 aa, Artificial Sequence
  Description of Artificial Sequence: Synthetic peptide
SGERLGNKYIC

SEQ ID NO: 95 - protein, 7 aa, Artificial Sequence
  Description of Artificial Sequence: Synthetic peptide
QDFKRPS

SEQ ID NO: 96 - protein, 9 aa, Artificial Sequence
  Description of Artificial Sequence: Synthetic peptide
QAWDSRTVV

SEQ ID NO: 97 - DNA, 42 bp, Artificial Sequence
  Description of Artificial Sequence: Synthetic oligonucleotide
actggaaccagcagtgatgttgggaattataaccttgtctcc

SEQ ID NO: 98 - DNA, 21 bp, Artificial Sequence
  Description of Artificial Sequence: Synthetic oligonucleotide
gaggtcaatcagcggccctca

SEQ ID NO: 99 - DNA, 33 bp, Artificial Sequence
  Description of Artificial Sequence: Synthetic oligonucleotide
tgctcatatacaactagtagcacttatgtgata

SEQ ID NO: 100 - protein, 14 aa, Artificial Sequence
  Description of Artificial Sequence: Synthetic peptide
TGTSSDVGNYNLVS

SEQ ID NO: 101 - protein, 7 aa, Artificial Sequence
  Description of Artificial Sequence: Synthetic peptide
EVNQRPS

SEQ ID NO: 102 - protein, 11 aa, Artificial Sequence
  Description of Artificial Sequence: Synthetic peptide
CSYTTSSTYVI

SEQ ID NO: 103 - DNA, 42 bp, Artificial Sequence
  Description of Artificial Sequence: Synthetic oligonucleotide
actggaaccagcagtgatgttggtggttatatctttgtctcc

SEQ ID NO: 104 - DNA, 21 bp, Artificial Sequence
  Description of Artificial Sequence: Synthetic oligonucleotide
gatgtcagtaagcggccctct

SEQ ID NO: 105 - DNA, 30 bp, Artificial Sequence
  Description of Artificial Sequence: Synthetic oligonucleotide
tgctcatatgcaggcaactacacttatgtc

SEQ ID NO: 106 - protein, 14 aa, Artificial Sequence
  Description of Artificial Sequence: Synthetic peptide
TGTSSDVGGYIFVS

SEQ ID NO: 107 - protein, 7 aa, Artificial Sequence
  Description of Artificial Sequence: Synthetic peptide
DVSKRPS

SEQ ID NO: 108 - protein, 10 aa, Artificial Sequence
  Description of Artificial Sequence: Synthetic peptide
CSYAGNYTYV

SEQ ID NO: 109 - DNA, 42 bp, Artificial Sequence; identical to SEQ ID NO: 97
  Description of Artificial Sequence: Synthetic oligonucleotide

SEQ ID NO: 110 - DNA, 21 bp, Artificial Sequence
  Description of Artificial Sequence: Synthetic oligonucleotide
gaggtcaataggcggccctca

SEQ ID NO: 111 - DNA, 33 bp, Artificial Sequence
  Description of Artificial Sequence: Synthetic oligonucleotide
tgctcatatgcaggtagagacactttcgtggtg

SEQ ID NO: 112 - protein, 14 aa, Artificial Sequence
  Description of Artificial Sequence: Synthetic peptide
TGTSSDVGNYNLVS

SEQ ID NO: 113 - protein, 7 aa, Artificial Sequence
  Description of Artificial Sequence: Synthetic peptide
EVNRRPS

SEQ ID NO: 114 - protein, 11 aa, Artificial Sequence
  Description of Artificial Sequence: Synthetic peptide
CSYAGRDTFVV

SEQ ID NO: 115 - DNA, 33 bp, Artificial Sequence
  Description of Artificial Sequence: Synthetic oligonucleotide
cgggcaagtcagaacattaccacctatttaaat

SEQ ID NO: 116 - DNA, 21 bp, Artificial Sequence
  Description of Artificial Sequence: Synthetic oligonucleotide
gctgcatcccgtttgcgaagt

SEQ ID NO: 117 - DNA, 27 bp, Artificial Sequence
  Description of Artificial Sequence: Synthetic oligonucleotide
caacagactttcactaccccgtggacg

SEQ ID NO: 118 - protein, 11 aa, Artificial Sequence
  Description of Artificial Sequence: Synthetic peptide
RASQNITTYLN

SEQ ID NO: 119 - protein, 7 aa, Artificial Sequence
  Description of Artificial Sequence: Synthetic peptide
AASRLRS

SEQ ID NO: 120 - protein, 9 aa, Artificial Sequence
  Description of Artificial Sequence: Synthetic peptide
QQTFTTPWT

SEQ ID NO: 121 - DNA, 33 bp, Artificial Sequence; identical to SEQ ID NO: 73
  Description of Artificial Sequence: Synthetic oligonucleotide

SEQ ID NO: 122 - DNA, 21 bp, Artificial Sequence
  Description of Artificial Sequence: Synthetic oligonucleotide
cctgcatccagtttacaaagt

SEQ ID NO: 123 - DNA, 27 bp, Artificial Sequence
  Description of Artificial Sequence: Synthetic oligonucleotide
ctacagcataatagttaccctctcact

SEQ ID NO: 124 - protein, 11 aa, Artificial Sequence
  Description of Artificial Sequence: Synthetic peptide
RASQGIRNDLG

SEQ ID NO: 125 - protein, 7 aa, Artificial Sequence
  Description of Artificial Sequence: Synthetic peptide
PASSLQS

SEQ ID NO: 126 - protein, 9 aa, Artificial Sequence
  Description of Artificial Sequence: Synthetic peptide
LQHNSYPLT

SEQ ID NO: 127 - DNA, 33 bp, Artificial Sequence
  Description of Artificial Sequence: Synthetic oligonucleotide
cgggcaggtcagaacattagcaggcatttaaat

SEQ ID NO: 128 - DNA, 21 bp, Artificial Sequence
  Description of Artificial Sequence: Synthetic oligonucleotide
cctgcatccagtttgccaagt

SEQ ID NO: 129 - DNA, 27 bp, Artificial Sequence
  Description of Artificial Sequence: Synthetic oligonucleotide
caacagagttacagtacccctcccact

SEQ ID NO: 130 - protein, 11 aa, Artificial Sequence
  Description of Artificial Sequence: Synthetic peptide
RAGQNISRHLN

SEQ ID NO: 131 - protein, 7 aa, Artificial Sequence
  Description of Artificial Sequence: Synthetic peptide
PASSLPS

SEQ ID NO: 132 - protein, 9 aa, Artificial Sequence
  Description of Artificial Sequence: Synthetic peptide
QQSYSTPPT

SEQ ID NO: 133 - DNA, 15 bp, Artificial Sequence
  Description of Artificial Sequence: Synthetic oligonucleotide
agccatggcatgcac

SEQ ID NO: 134 - DNA, 51 bp, Artificial Sequence
  Description of Artificial Sequence: Synthetic oligonucleotide
gttatctggtatgatggaagtaatgaatactatggagactccgtgaagggc

SEQ ID NO: 135 - DNA, 48 bp, Artificial Sequence
  Description of Artificial Sequence: Synthetic oligonucleotide
ggggggggccactggaactacgagggccactactatggtatggacgtc

SEQ ID NO: 136 - protein, 5 aa, Artificial Sequence
  Description of Artificial Sequence: Synthetic peptide
SHGMH

SEQ ID NO: 137 - protein, 17 aa, Artificial Sequence
  Description of Artificial Sequence: Synthetic peptide
VIWYDGSNEYYGDSVKG

SEQ ID NO: 138 - protein, 16 aa, Artificial Sequence
  Description of Artificial Sequence: Synthetic peptide
GGGHWNYEGHYYGMDV

SEQ ID NO: 139 - DNA, 21 bp, Artificial Sequence
  Description of Artificial Sequence: Synthetic oligonucleotide
agcagccgtactgcttggaac

SEQ ID NO: 140 - DNA, 54 bp, Artificial Sequence
  Description of Artificial Sequence: Synthetic oligonucleotide
aggacatactacaggtccaagtggtatcatgattattcagtatctgtgaaaagt

SEQ ID NO: 141 - DNA, 21 bp, Artificial Sequence
  Description of Artificial Sequence: Synthetic oligonucleotide
ggggctgctccctttgactac

SEQ ID NO: 142 - protein, 7 aa, Artificial Sequence
  Description of Artificial Sequence: Synthetic peptide
SSRTAWN

SEQ ID NO: 143 - protein, 18 aa, Artificial Sequence
  Description of Artificial Sequence: Synthetic peptide
RTYYRSKWYHDYSVSVKS

SEQ ID NO: 144 - protein, 7 aa, Artificial Sequence
  Description of Artificial Sequence: Synthetic peptide
GAAPFDY

SEQ ID NO: 145 - DNA, 15 bp, Artificial Sequence
  Description of Artificial Sequence: Synthetic oligonucleotide
ggctactatatgcac

SEQ ID NO: 146 - DNA, 51 bp, Artificial Sequence
  Description of Artificial Sequence: Synthetic oligonucleotide
tggatcaaccctcacagtggtggcacaaactatgcacagaagtttcaggac

SEQ ID NO: 147 - DNA, 48 bp, Artificial Sequence
  Description of Artificial Sequence: Synthetic oligonucleotide
gaacgtatttctatggttcggggagtcgggcacaactggttcgccccc

SEQ ID NO: 148 - protein, 5 aa, Artificial Sequence
  Description of Artificial Sequence: Synthetic peptide
GYYMH

SEQ ID NO: 149 - protein, 17 aa, Artificial Sequence
  Description of Artificial Sequence: Synthetic peptide
WINPHSGGTNYAQKFQD

SEQ ID NO: 150 - protein, 16 aa, Artificial Sequence
  Description of Artificial Sequence: Synthetic peptide
ERISMVRGVGHNWFAP

SEQ ID NO: 151 - DNA, 15 bp, Artificial Sequence
  Description of Artificial Sequence: Synthetic oligonucleotide
gcctactatatacac

SEQ ID NO: 152 - DNA, 51 bp, Artificial Sequence
  Description of Artificial Sequence: Synthetic oligonucleotide
tggctcaaccctgacagtggtggcacaaactttgccccgaggtttcaggac

SEQ ID NO: 153 - DNA, 36 bp, Artificial Sequence
  Description of Artificial Sequence: Synthetic oligonucleotide
gagaagtttaactacaactatggtgcttttgatatc

SEQ ID NO: 154 - protein, 5 aa, Artificial Sequence
  Description of Artificial Sequence: Synthetic peptide
AYYIH

SEQ ID NO: 155 - protein, 17 aa, Artificial Sequence
  Description of Artificial Sequence: Synthetic peptide
WLNPDSGGTNFAPRFQD

SEQ ID NO: 156 - protein, 12 aa, Artificial Sequence
  Description of Artificial Sequence: Synthetic peptide
EKFNYNYGAFDI

SEQ ID NO: 157 - DNA, 15 bp, Artificial Sequence
  Description of Artificial Sequence: Synthetic oligonucleotide
gactactatatacac

SEQ ID NO: 158 - DNA, 51 bp, Artificial Sequence
  Description of Artificial Sequence: Synthetic oligonucleotide
tggatcaaccctaacagtggtgacacaagctatgcacagaagtttcaggac

SEQ ID NO: 159 - DNA, 51 bp, Artificial Sequence
  Description of Artificial Sequence: Synthetic oligonucleotide
gaggtggggggctatggttcggggacctaccgctattacggtatggacgtc

SEQ ID NO: 160 - protein, 5 aa, Artificial Sequence
  Description of Artificial Sequence: Synthetic peptide
DYYIH

SEQ ID NO: 161 - protein, 17 aa, Artificial Sequence
  Description of Artificial Sequence: Synthetic peptide
WINPNSGDTSYAQKFQD

SEQ ID NO: 162 - protein, 17 aa, Artificial Sequence
  Description of Artificial Sequence: Synthetic peptide
EVGGYGSGTYRYYGMDV

SEQ ID NO: 163 - DNA, 15 bp, Artificial Sequence
  Description of Artificial Sequence: Synthetic oligonucleotide
gactactatattcac

SEQ ID NO: 164 - DNA, 51 bp, Artificial Sequence
  Description of Artificial Sequence: Synthetic oligonucleotide
tggatcaaccctaacagtggcggcacaaactatgcacagaagtttcagggc

SEQ ID NO: 165 - DNA, 51 bp, Artificial Sequence
  Description of Artificial Sequence: Synthetic oligonucleotide
gaagatggggcagcagttggtcccctctactactactacggtatggacgtc

SEQ ID NO: 166 - protein, 5 aa, Artificial Sequence
  Description of Artificial Sequence: Synthetic peptide
DYYIH

SEQ ID NO: 167 - protein, 17 aa, Artificial Sequence
  Description of Artificial Sequence: Synthetic peptide
WINPNSGGTNYAQKFQG

SEQ ID NO: 168 - protein, 17 aa, Artificial Sequence
  Description of Artificial Sequence: Synthetic peptide
EDGAAVGPLYYYYGMDV

SEQ ID NO: 169 - DNA, 15 bp, Artificial Sequence
  Description of Artificial Sequence: Synthetic oligonucleotide
gactactacatgagc

SEQ ID NO: 170 - DNA, 51 bp, Artificial Sequence
  Description of Artificial Sequence: Synthetic oligonucleotide
tatattagtcgaagtggtgataccatatactacgcagactctgtgaagggc

SEQ ID NO: 171 - DNA, 36 bp, Artificial Sequence
  Description of Artificial Sequence: Synthetic oligonucleotide
gacttagcagcaggtgctacagggggccttgactgc

SEQ ID NO: 172 - protein, 5 aa, Artificial Sequence
  Description of Artificial Sequence: Synthetic peptide
DYYMS

SEQ ID NO: 173 - protein, 17 aa, Artificial Sequence
  Description of Artificial Sequence: Synthetic peptide
YISRSGDTIYYADSVKG

SEQ ID NO: 174 - protein, 12 aa, Artificial Sequence
  Description of Artificial Sequence: Synthetic peptide
DLAAGATGGLDC

SEQ ID NO: 175 - DNA, 15 bp, Artificial Sequence
  Description of Artificial Sequence: Synthetic oligonucleotide
agaaatgccatgagt

SEQ ID NO: 176 - DNA, 51 bp, Artificial Sequence
  Description of Artificial Sequence: Synthetic oligonucleotide
gctactggtggtagtggtattagcacatactacgcagactccgtgaagggc

SEQ ID NO: 177 - DNA, 33 bp, Artificial Sequence
  Description of Artificial Sequence: Synthetic oligonucleotide
ggttatagcaacagctggtggtactttgactac

SEQ ID NO: 178 - protein, 5 aa, Artificial Sequence
  Description of Artificial Sequence: Synthetic peptide
RNAMS

SEQ ID NO: 179 - protein, 17 aa, Artificial Sequence
  Description of Artificial Sequence: Synthetic peptide
ATGGSGISTYYADSVKG

SEQ ID NO: 180 - protein, 11 aa, Artificial Sequence
  Description of Artificial Sequence: Synthetic peptide
GYSNSWWYFDY

SEQ ID NO: 181 - DNA, 15 bp, Artificial Sequence
  Description of Artificial Sequence: Synthetic oligonucleotide
agctatggcatgcac

SEQ ID NO: 182 - DNA, 51 bp, Artificial Sequence
  Description of Artificial Sequence: Synthetic oligonucleotide
gttatatggtatgatggaagtaataaatactatgcagactccgtgaagggc

SEQ ID NO: 183 - DNA, 30 bp, Artificial Sequence
  Description of Artificial Sequence: Synthetic oligonucleotide
gatggccggaactacgtctactttgacaac

SEQ ID NO: 184 - protein, 5 aa, Artificial Sequence
  Description of Artificial Sequence: Synthetic peptide
SYGMH

SEQ ID NO: 185 - protein, 17 aa, Artificial Sequence
  Description of Artificial Sequence: Synthetic peptide
VIWYDGSNKYYADSVKG

SEQ ID NO: 186 - protein, 10 aa, Artificial Sequence
  Description of Artificial Sequence: Synthetic peptide
DGRNYVYFDN

SEQ ID NO: 187 - DNA, 15 bp, Artificial Sequence
  Description of Artificial Sequence: Synthetic oligonucleotide
ggctactatatgcac

SEQ ID NO: 188 - DNA, 51 bp, Artificial Sequence
  Description of Artificial Sequence: Synthetic oligonucleotide
tggatcaaccctgacagtggtggcacaaagtatacacagaagtttcagggc

SEQ ID NO: 189 - DNA, 36 bp, Artificial Sequence
  Description of Artificial Sequence: Synthetic oligonucleotide
gagaggtgtaggactaccaactgctatttggactac

SEQ ID NO: 190 - protein, 5 aa, Artificial Sequence
  Description of Artificial Sequence: Synthetic peptide
GYYMH

SEQ ID NO: 191 - protein, 17 aa, Artificial Sequence
  Description of Artificial Sequence: Synthetic peptide
WINPDSGGTKYTQKFQG

SEQ ID NO: 192 - protein, 12 aa, Artificial Sequence
  Description of Artificial Sequence: Synthetic peptide
ERCRTTNCYLDY

SEQ ID NO: 193 - DNA, 15 bp, Artificial Sequence
  Description of Artificial Sequence: Synthetic oligonucleotide
ggctactatatgcac

SEQ ID NO: 194 - DNA, 51 bp, Artificial Sequence
  Description of Artificial Sequence: Synthetic oligonucleotide
tggatcaaccctgacagtggaggcacaaactttgcacagcagtttcagggc

SEQ ID NO: 195 - DNA, 36 bp, Artificial Sequence
  Description of Artificial Sequence: Synthetic oligonucleotide
gagaagataactatgactggtatttactttgactat

SEQ ID NO: 196 - protein, 5 aa, Artificial Sequence
  Description of Artificial Sequence: Synthetic peptide
GYYMH

SEQ ID NO: 197 - protein, 17 aa, Artificial Sequence
  Description of Artificial Sequence: Synthetic peptide
WINPDSGGTNFAQQFQG

SEQ ID NO: 198 - protein, 12 aa, Artificial Sequence
  Description of Artificial Sequence: Synthetic peptide
EKITMTGIYFDY

SEQ ID NO: 199 - DNA, 15 bp, Artificial Sequence
  Description of Artificial Sequence: Synthetic oligonucleotide
ggctactatatacac

SEQ ID NO: 200 - DNA, 51 bp, Artificial Sequence
  Description of Artificial Sequence: Synthetic oligonucleotide
tggatcaaccctgacagtggtgacacaaactatgcacagaagtttcagggc

SEQ ID NO: 201 - DNA, 51 bp, Artificial Sequence
  Description of Artificial Sequence: Synthetic oligonucleotide
gagaggttaacacattgtggtggtgactgctattcccaatggttcgacccc

SEQ ID NO: 202 - protein, 5 aa, Artificial Sequence
  Description of Artificial Sequence: Synthetic peptide
GYYIH

SEQ ID NO: 203 - protein, 17 aa, Artificial Sequence
  Description of Artificial Sequence: Synthetic peptide
WINPDSGDTNYAQKFQG

SEQ ID NO: 204 - protein, 17 aa, Artificial Sequence
  Description of Artificial Sequence: Synthetic peptide
ERLTHCGGDCYSQWFDP

SEQ ID NO: 205 - DNA, 15 bp, Artificial Sequence
  Description of Artificial Sequence: Synthetic oligonucleotide
ggctactatatgtac

SEQ ID NO: 206 - DNA, 51 bp, Artificial Sequence; identical to SEQ ID NO: 200
  Description of Artificial Sequence: Synthetic oligonucleotide

SEQ ID NO: 207 - DNA, 48 bp, Artificial Sequence
  Description of Artificial Sequence: Synthetic oligonucleotide
gagaagcccagatattttgactccttctactactaccttatggacgtc

SEQ ID NO: 208 - protein, 5 aa, Artificial Sequence
  Description of Artificial Sequence: Synthetic peptide
GYYMY

SEQ ID NO: 209 - protein, 17 aa, Artificial Sequence
  Description of Artificial Sequence: Synthetic peptide
WINPDSGDTNYAQKFQG

SEQ ID NO: 210 - protein, 16 aa, Artificial Sequence
  Description of Artificial Sequence: Synthetic peptide
EKPRYFDSFYYYLMDV

SEQ ID NO: 211 - DNA, 341 bp, Artificial Sequence
  Description of Artificial Sequence: Synthetic polynucleotide
gacattgtgatgactcagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgagaatccggggtccctgaccgattcagtggcagcgggtctgggacagatttcactctcaccatcagcagcctgcaggctgaagatgtggcagtttattactgtcagcaatattatagtactcctccgacgttcggccaagggaccaaggtggagatcaaacg

SEQ ID NO: 212 - DNA, 354 bp, Artificial Sequence
  Description of Artificial Sequence: Synthetic polynucleotide
gaggtgcagctggtcgagtctggaggaggcttgatccagcctggggggtccctgagactctcctgtgcagtctctgggttcaccgtcagtagcaagttcatgacctgggtccgccaggctccagggaaggggctggagtgggtctcagttatttatagcggtggtaagacatactacgcagactccgtgaagggccgattcaccatctccagagacaattccaagaacacgctgtatcttcaaatgaacagcctgagagccgaggacacggccgtgtattactgtgcgagagatagcggtggctgggggtactttgactactggggccagggaaccctggtcaccgtgtcctca

SEQ ID NO: 213 - protein, 114 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIKR

SEQ ID NO: 214 - protein, 118 aa, Artificial Sequence
  Description of Artificial Sequence: Synthetic polypeptide
EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSS

SEQ ID NO: 215 - DNA, 324 bp, Artificial Sequence
  Description of Artificial Sequence: Synthetic polynucleotide
gacatccagatgacccagtctccatcttccgtgtctgcttctgtcggagacagagtcaccatcacttgtcgggcgagtcaggatattagcaggtggttagcctggtatcagcagaaaccagggaaagcccctaagctcctgatttctgctgcatccagattgcaaagtggagtcccatcaaggttcagcggcagtggatctgggacagatttcactctcaccatcagcagcctgcagcctgaagattttgcaatttactattgtcaacaggctaaaagttttcctcggacgttcggccaagggaccaaggtggaaatcaaacga

SEQ ID NO: 216 - DNA, 351 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatatattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctca

SEQ ID NO: 217 - protein, 108 aa, Artificial Sequence
  Description of Artificial Sequence: Synthetic polypeptide
DIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIKR

SEQ ID NO: 218 - protein, 117 aa, Artificial Sequence
  Description of Artificial Sequence: Synthetic polypeptide
QVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSS

SEQ ID NO: 219-220 - skipped (2 entries)

SEQ ID NO: 221 - protein, 111 aa, Artificial Sequence
  Description of Artificial Sequence: Synthetic polypeptide
QSVLTQPPSVSGAPGQRVTISCTGSSSNIGAGYDVHWYQQVPGTAPKLLIYGNSKRPSGVPDRFSGSKSGTSASLAITGLQAEDEADYYCQSYDSSLGGWVFGGGTKLTVL

SEQ ID NO: 222 - protein, 119 aa, Artificial Sequence
  Description of Artificial Sequence: Synthetic polypeptide
QVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARPSNYDAFDIWGQGTMVTVSS

SEQ ID NO: 223-224 - skipped (2 entries)

SEQ ID NO: 225 - protein, 107 aa, Artificial Sequence
  Description of Artificial Sequence: Synthetic polypeptide
DIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGQGTKVEIK

SEQ ID NO: 226 - protein, 117 aa, Artificial Sequence
  Description of Artificial Sequence: Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSS

SEQ ID NO: 227 - DNA, 51 bp, Artificial Sequence
  Description of Artificial Sequence: Synthetic oligonucleotide
aagtccagccagagtgttttatacagctccaacaataagaactacttagct

SEQ ID NO: 228 - DNA, 21 bp, Artificial Sequence
  Description of Artificial Sequence: Synthetic oligonucleotide
tgggcatctacccgagaatcc

SEQ ID NO: 229 - DNA, 27 bp, Artificial Sequence
  Description of Artificial Sequence: Synthetic oligonucleotide
cagcaatattatagtactcctccgacg

SEQ ID NO: 230 - protein, 17 aa, Artificial Sequence
  Description of Artificial Sequence: Synthetic peptide
KSSQSVLYSSNNKNYLA

SEQ ID NO: 231 - protein, 7 aa, Artificial Sequence
  Description of Artificial Sequence: Synthetic peptide
WASTRES

SEQ ID NO: 232 - protein, 9 aa, Artificial Sequence
  Description of Artificial Sequence: Synthetic peptide
QQYYSTPPT

SEQ ID NO: 233 - DNA, 33 bp, Artificial Sequence
  Description of Artificial Sequence: Synthetic oligonucleotide
cgggcgagtcaggatattagcaggtggttagcc

SEQ ID NO: 234 - DNA, 21 bp, Artificial Sequence
  Description of Artificial Sequence: Synthetic oligonucleotide
gctgcatccagattgcaaagt

SEQ ID NO: 235 - DNA, 27 bp, Artificial Sequence
  Description of Artificial Sequence: Synthetic oligonucleotide
caacaggctaaaagttttcctcggacg

SEQ ID NO: 236 - protein, 11 aa, Artificial Sequence
  Description of Artificial Sequence: Synthetic peptide
RASQDISRWLA

SEQ ID NO: 237 - protein, 7 aa, Artificial Sequence
  Description of Artificial Sequence: Synthetic peptide
AASRLQS

SEQ ID NO: 238 - protein, 9 aa, Artificial Sequence
  Description of Artificial Sequence: Synthetic peptide
QQAKSFPRT

SEQ ID NO: 239-241 - skipped (3 entries)

SEQ ID NO: 242 - protein, 14 aa, Artificial Sequence
  Description of Artificial Sequence: Synthetic peptide
TGSSSNIGAGYDVH

SEQ ID NO: 243 - protein, 7 aa, Artificial Sequence
  Description of Artificial Sequence: Synthetic peptide
GNSKRPS

SEQ ID NO: 244 - protein, 11 aa, Artificial Sequence
  Description of Artificial Sequence: Synthetic peptide
QSYDSSLGGWV

SEQ ID NO: 245-247 - skipped (3 entries)

SEQ ID NO: 248 - protein, 11 aa, Artificial Sequence
  Description of Artificial Sequence: Synthetic peptide
RASQGITRWLA

SEQ ID NO: 249 - protein, 7 aa, Artificial Sequence
  Description of Artificial Sequence: Synthetic peptide
AASVLQS

SEQ ID NO: 250 - protein, 9 aa, Artificial Sequence
  Description of Artificial Sequence: Synthetic peptide
QQSNSFPRT

SEQ ID NO: 251 - DNA, 15 bp, Artificial Sequence
  Description of Artificial Sequence: Synthetic oligonucleotide
agcaagttcatgacc

SEQ ID NO: 252 - DNA, 48 bp, Artificial Sequence
  Description of Artificial Sequence: Synthetic oligonucleotide
gttatttatagcggtggtaagacatactacgcagactccgtgaagggc

SEQ ID NO: 253 - DNA, 30 bp, Artificial Sequence
  Description of Artificial Sequence: Synthetic oligonucleotide
gatagcggtggctgggggtactttgactac

SEQ ID NO: 254 - protein, 5 aa, Artificial Sequence
  Description of Artificial Sequence: Synthetic peptide
SKFMT

SEQ ID NO: 255 - protein, 16 aa, Artificial Sequence
  Description of Artificial Sequence: Synthetic peptide
VIYSGGKTYYADSVKG

SEQ ID NO: 256 - protein, 10 aa, Artificial Sequence
  Description of Artificial Sequence: Synthetic peptide
DSGGWGYFDY

SEQ ID NO: 257 - DNA, 15 bp, Artificial Sequence
  Description of Artificial Sequence: Synthetic oligonucleotide
gactactacatgagc

SEQ ID NO: 258 - DNA, 51 bp, Artificial Sequence
  Description of Artificial Sequence: Synthetic oligonucleotide
tacattagtagcagtgaaagtatcatatattacgtagactctgtgaagggc

SEQ ID NO: 259 - DNA, 24 bp, Artificial Sequence
  Description of Artificial Sequence: Synthetic oligonucleotide
gatgttgggagccactttgactac

SEQ ID NO: 260 - protein, 5 aa, Artificial Sequence
  Description of Artificial Sequence: Synthetic peptide
DYYMS

SEQ ID NO: 261 - protein, 17 aa, Artificial Sequence
  Description of Artificial Sequence: Synthetic peptide
YISSSESIIYYVDSVKG

SEQ ID NO: 262 - protein, 8 aa, Artificial Sequence
  Description of Artificial Sequence: Synthetic peptide
DVGSHFDY

SEQ ID NO: 263-265 - skipped (3 entries)

SEQ ID NO: 266 - protein, 7 aa, Artificial Sequence
  Description of Artificial Sequence: Synthetic peptide
SSSYYWG

SEQ ID NO: 267 - protein, 16 aa, Artificial Sequence
  Description of Artificial Sequence: Synthetic peptide
SIYYSGITNYNPSLKS

SEQ ID NO: 268 - protein, 9 aa, Artificial Sequence
  Description of Artificial Sequence: Synthetic peptide
PSNYDAFDI

SEQ ID NO: 269-271 - skipped (3 entries)

SEQ ID NO: 272 - protein, 5 aa, Artificial Sequence
  Description of Artificial Sequence: Synthetic peptide
DYYMT

SEQ ID NO: 273 - protein, 17 aa, Artificial Sequence
  Description of Artificial Sequence: Synthetic peptide
YISSSGSTIYYADSVKG

SEQ ID NO: 274 - protein, 8 aa, Artificial Sequence
  Description of Artificial Sequence: Synthetic peptide
DRNSHFDY

SEQ ID NO: 275 - skipped

SEQ ID NO: 276 - protein, 246 aa, Artificial Sequence
  Description of Artificial Sequence: Synthetic polypeptide
EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSGGGGSGGGGSGGGGSDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIK

SEQ ID NO: 277 - skipped

SEQ ID NO: 278 - protein, 239 aa, Artificial Sequence
  Description of Artificial Sequence: Synthetic polypeptide
QVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIK

SEQ ID NO: 279 - skipped

SEQ ID NO: 280 - protein, 245 aa, Artificial Sequence
  Description of Artificial Sequence: Synthetic polypeptide
QVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARPSNYDAFDIWGQGTMVTVSSGGGGSGGGGSGGGGSQSVLTQPPSVSGAPGQRVTISCTGSSSNIGAGYDVHWYQQVPGTAPKLLIYGNSKRPSGVPDRFSGSKSGTSASLAITGLQAEDEADYYCQSYDSSLGGWVFGGGTKLTVL

SEQ ID NO: 281 - skipped

SEQ ID NO: 282 - protein, 239 aa, Artificial Sequence
  Description of Artificial Sequence: Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGQGTKVEIK

SEQ ID NO: 283 - DNA, 2097 bp, Artificial Sequence
  Description of Artificial Sequence: Synthetic polynucleotide
caggtgcagctggtgcagtctggggctgaggtgaagaagcctggggcctcagtgaaggtgtcctgcaaggcttctggatacaccttcgccggctactatatgcactgggtgcgacaggcccctggacaagggcttgagtggatgggatggatcaaccctgacagtggaggcacaaactttgcacagcagtttcagggcagggtcaccatgaccagggatacgtccatcagcacagcctacatggaggtgagcaggctgagatctgacgacacggccgtgttttactgtgcgagagagaagatcactatgactggtatttactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtcgagtctgggggaggcttggtcaagcctggagggtccctgagactctcctgtgcagcctctggattcaccttcagtgactactacatgacctggatcaggcaggctccagggaagtgcctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcaggagggggcggatctggcggcggaggaagcggtgggggcggctccgacattcagatgacccagtctccatcttccgtgtctgcatctgtaggggacagagtcaccatcacttgtcgggcgagtcagggtattaccaggtggttagcctggtatcagcagaaaccagggaaagcccctaagctcctgatctatgctgcatccgttttgcaaagtggggtcccatcaaggttcagcggcagtggatctgggacagatttcactctcaccatcagcagcctgcagcctgaagattttgcaacttactattgtcaacagtctaacagtttccctcggacgttcggctgcgggaccaaggtggaaatcaaacgg

SEQ ID NO: 284 - DNA, 642 bp, Artificial Sequence
  Description of Artificial Sequence: Synthetic polynucleotide
gacatccagatgacccagtctccatcctccctgtctgcatctgtaggagacattctcaccatcacttgccgggcaagtcagaacattaccacctatttaaattggtatcagcagaaaccagggaaagcccctaacctcctgatctctgctgcatcccgtttgcgaagtggggtcccatcaaggttcagtggcagtggatctgggacagatttcactctcaccatcagcagtctgcaacctgtagattttacaactttctactgtcaacagactttcactaccccgtggacgttcggccaagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 285 - protein, 699 aa, Artificial Sequence
  Description of Artificial Sequence: Synthetic polypeptide
QVQLVQSGAEVKKPGASVKVSCKASGYTFAGYYMHWVRQAPGQGLEWMGWINPDSGGTNFAQQFQGRVTMTRDTSISTAYMEVSRLRSDDTAVFYCAREKITMTGIYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMTWIRQAPGKCLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGCGTKVEIKR

SEQ ID NO: 286 - protein, 214 aa, Artificial Sequence
  Description of Artificial Sequence: Synthetic polypeptide
DIQMTQSPSSLSASVGDILTITCRASQNITTYLNWYQQKPGKAPNLLISAASRLRSGVPSRFSGSGSGTDFTLTISSLQPVDFTTFYCQQTFTTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 287 - DNA, 2097 bp, Artificial Sequence
  Description of Artificial Sequence: Synthetic polynucleotide
caggtgcagctggtgcagtctggggctgaggtgaagaagcctggggcctcagtgaaggtgtcctgcaaggcttctggatacaccttcgccggctactatatgcactgggtgcgacaggcccctggacaagggcttgagtggatgggatggatcaaccctgacagtggaggcacaaactttgcacagcagtttcagggcagggtcaccatgaccagggatacgtccatcagcacagcctacatggaggtgagcaggctgagatctgacgacacggccgtgttttactgtgcgagagagaagatcactatgactggtatttactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaagtgcctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcaggagggggcggatctggcggcggaggaagcggtgggggcggctccgacatccagatgacccagtctccatcttccgtgtctgcttctgtcggagacagagtcaccatcacttgtcgggcgagtcaggatattagcaggtggttagcctggtatcagcagaaaccagggaaagcccctaagctcctgatttctgctgcatccagattgcaaagtggagtcccatcaaggttcagcggcagtggatctgggacagatttcactctcaccatcagcagcctgcagcctgaagattttgcaatttactattgtcaacaggctaaaagttttcctcggacgttcggctgcgggaccaaggtggaaatcaaacgg

SEQ ID NO: 288 - DNA, 642 bp, Artificial Sequence; identical to SEQ ID NO: 284
  Description of Artificial Sequence: Synthetic polynucleotide

SEQ ID NO: 289 - protein, 699 aa, Artificial Sequence
  Description of Artificial Sequence: Synthetic polypeptide
QVQLVQSGAEVKKPGASVKVSCKASGYTFAGYYMHWVRQAPGQGLEWMGWINPDSGGTNFAQQFQGRVTMTRDTSISTAYMEVSRLRSDDTAVFYCAREKITMTGIYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKCLEWISYISSSESIIYYVDSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKR

SEQ ID NO: 290 - protein, 214 aa, Artificial Sequence; identical to SEQ ID NO: 286
  Description of Artificial Sequence: Synthetic polypeptide

SEQ ID NO: 291 - DNA, 2109 bp, Artificial Sequence
  Description of Artificial Sequence: Synthetic polynucleotide
caggtgcaactggtgcagtctggggctgaggtgacgaagcctggggcctcagtgaaggtgtcctgcaaggcttctggatacaccttcgccggctactatatgcactgggtgcgacaggcccctggacaagggcttgagtggatgggatggatcaaccctcacagtggtggcacaaactatgcacagaagtttcaggacagggtcaccatgaccagggacacgtccatcaacacagcctacatggaactgagcaggctgagatctgacgacacggccgtgtattactgtgcgagagaacgtatttctatggttcggggagtcgggcacaactggttcgccccctggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtcgagtctgggggaggcttggtcaagcctggagggtccctgagactctcctgtgcagcctctggattcaccttcagtgactactacatgacctggatcaggcaggctccagggaagtgcctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcaggagggggcggatctggcggcggaggaagcggtgggggcggctccgacattcagatgacccagtctccatcttccgtgtctgcatctgtaggggacagagtcaccatcacttgtcgggcgagtcagggtattaccaggtggttagcctggtatcagcagaaaccagggaaagcccctaagctcctgatctatgctgcatccgttttgcaaagtggggtcccatcaaggttcagcggcagtggatctgggacagatttcactctcaccatcagcagcctgcagcctgaagattttgcaacttactattgtcaacagtctaacagtttccctcggacgttcggctgcgggaccaaggtggaaatcaaacgg

SEQ ID NO: 292 - DNA, 642 bp, Artificial Sequence
  Description of Artificial Sequence: Synthetic polynucleotide
gacatccagatgacccagtctccatcctcactgtctgcatctgtaggagacagagtcaccatcacctgtcgggcgagtcaggacattagcaataatttagcctggtttcagcagaaaccagggaaaccccctaagtccctgatgtatgctgcatccagtttgcacagtggagtcccatcaacgttcagcggcagtggatctgggacagatttcactttcaccatcagcagcctgcagcctgaagattttgcaacttattactgccaacagtataatagttaccctctcactttcggcggagggaccaaggtggagatcagacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 293 - protein, 703 aa, Artificial Sequence
  Description of Artificial Sequence: Synthetic polypeptide
QVQLVQSGAEVTKPGASVKVSCKASGYTFAGYYMHWVRQAPGQGLEWMGWINPHSGGTNYAQKFQDRVTMTRDTSINTAYMELSRLRSDDTAVYYCARERISMVRGVGHNWFAPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMTWIRQAPGKCLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGCGTKVEIKR

SEQ ID NO: 294 - protein, 214 aa, Artificial Sequence
  Description of Artificial Sequence: Synthetic polypeptide
DIQMTQSPSSLSASVGDRVTITCRASQDISNNLAWFQQKPGKPPKSLMYAASSLHSGVPSTFSGSGSGTDFTFTISSLQPEDFATYYCQQYNSYPLTFGGGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 295 - DNA, 2109 bp, Artificial Sequence
  Description of Artificial Sequence: Synthetic polynucleotide
caggtgcaactggtgcagtctggggctgaggtgacgaagcctggggcctcagtgaaggtgtcctgcaaggcttctggatacaccttcgccggctactatatgcactgggtgcgacaggcccctggacaagggcttgagtggatgggatggatcaaccctcacagtggtggcacaaactatgcacagaagtttcaggacagggtcaccatgaccagggacacgtccatcaacacagcctacatggaactgagcaggctgagatctgacgacacggccgtgtattactgtgcgagagaacgtatttctatggttcggggagtcgggcacaactggttcgccccctggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaagtgcctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcaggagggggcggatctggcggcggaggaagcggtgggggcggctccgacatccagatgacccagtctccatcttccgtgtctgcttctgtcggagacagagtcaccatcacttgtcgggcgagtcaggatattagcaggtggttagcctggtatcagcagaaaccagggaaagcccctaagctcctgatttctgctgcatccagattgcaaagtggagtcccatcaaggttcagcggcagtggatctgggacagatttcactctcaccatcagcagcctgcagcctgaagattttgcaatttactattgtcaacaggctaaaagttttcctcggacgttcggctgcgggaccaaggtggaaatcaaacgg

SEQ ID NO: 296 - DNA, 642 bp, Artificial Sequence; identical to SEQ ID NO: 292
  Description of Artificial Sequence: Synthetic polynucleotide

SEQ ID NO: 297 - protein, 703 aa, Artificial Sequence
  Description of Artificial Sequence: Synthetic polypeptide
QVQLVQSGAEVTKPGASVKVSCKASGYTFAGYYMHWVRQAPGQGLEWMGWINPHSGGTNYAQKFQDRVTMTRDTSINTAYMELSRLRSDDTAVYYCARERISMVRGVGHNWFAPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKCLEWISYISSSESIIYYVDSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKR

SEQ ID NO: 298 - protein, 214 aa, Artificial Sequence; identical to SEQ ID NO: 294
  Description of Artificial Sequence: Synthetic polypeptide

SEQ ID NO: 299 - DNA, 2094 bp, Artificial Sequence
  Description of Artificial Sequence: Synthetic polynucleotide
gaggtgcagctgctggagtctgggggaggcttggtacagcctggggggtccctgagactctcctgtgcagcctctggattcacctttagtagaaatgccatgagttgggtccgccaggctccagggaaggggctggagtgggtgtcagctactggtggtagtggtattagcacatactacgcagactccgtgaagggccggttcaccatctccagagacaattccaagaacacgctgtatctgcaaatgaacagtctgagagccgaggacacggccgtatattactgtgcgagaggttatagcaacagctggtggtactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtcgagtctgggggaggcttggtcaagcctggagggtccctgagactctcctgtgcagcctctggattcaccttcagtgactactacatgacctggatcaggcaggctccagggaagtgcctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcaggagggggcggatctggcggcggaggaagcggtgggggcggctccgacattcagatgacccagtctccatcttccgtgtctgcatctgtaggggacagagtcaccatcacttgtcgggcgagtcagggtattaccaggtggttagcctggtatcagcagaaaccagggaaagcccctaagctcctgatctatgctgcatccgttttgcaaagtggggtcccatcaaggttcagcggcagtggatctgggacagatttcactctcaccatcagcagcctgcagcctgaagattttgcaacttactattgtcaacagtctaacagtttccctcggacgttcggctgcgggaccaaggtggaaatcaaacgg

SEQ ID NO: 300 - DNA, 651 bp, Artificial Sequence
  Description of Artificial Sequence: Synthetic polynucleotide
cagtctgccctgactcagcctgcctccgtgtctgggagccctggacagtcgatcaccatctcctgcactggaaccagcagtgatgttgggaattataaccttgtctcctggtaccaacagcacccaggcaaagcccccaaactcatgatttttgaggtcaatcagcggccctcaggggtttctaatcgcttctctggctccaagtctggcaccacggcctccctgacaatctctgggctccaggctgcggacgaggctgattatttctgctgctcatatacaactagtagcacttatgtgatcttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 301 - protein, 698 aa, Artificial Sequence
  Description of Artificial Sequence: Synthetic polypeptide
EVQLLESGGGLVQPGGSLRLSCAASGFTFSRNAMSWVRQAPGKGLEWVSATGGSGISTYYADSVKGRFTISRDNSKNTLYLQMNSLRAEDTAVYYCARGYSNSWWYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMTWIRQAPGKCLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGCGTKVEIKR

SEQ ID NO: 302 - protein, 217 aa, Artificial Sequence
  Description of Artificial Sequence: Synthetic polypeptide
QSALTQPASVSGSPGQSITISCTGTSSDVGNYNLVSWYQQHPGKAPKLMIFEVNQRPSGVSNRFSGSKSGTTASLTISGLQAADEADYFCCSYTTSSTYVIFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 303 - DNA, 2094 bp, Artificial Sequence
  Description of Artificial Sequence: Synthetic polynucleotide
gaggtgcagctgctggagtctgggggaggcttggtacagcctggggggtccctgagactctcctgtgcagcctctggattcacctttagtagaaatgccatgagttgggtccgccaggctccagggaaggggctggagtgggtgtcagctactggtggtagtggtattagcacatactacgcagactccgtgaagggccggttcaccatctccagagacaattccaagaacacgctgtatctgcaaatgaacagtctgagagccgaggacacggccgtatattactgtgcgagaggttatagcaacagctggtggtactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaagtgcctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcaggagggggcggatctggcggcggaggaagcggtgggggcggctccgacatccagatgacccagtctccatcttccgtgtctgcttctgtcggagacagagtcaccatcacttgtcgggcgagtcaggatattagcaggtggttagcctggtatcagcagaaaccagggaaagcccctaagctcctgatttctgctgcatccagattgcaaagtggagtcccatcaaggttcagcggcagtggatctgggacagatttcactctcaccatcagcagcctgcagcctgaagattttgcaatttactattgtcaacaggctaaaagttttcctcggacgttcggctgcgggaccaaggtggaaatcaaacgg

SEQ ID NO: 304 - DNA, 651 bp, Artificial Sequence; identical to SEQ ID NO: 300
  Description of Artificial Sequence: Synthetic polynucleotide

SEQ ID NO: 305 - protein, 698 aa, Artificial Sequence
  Description of Artificial Sequence: Synthetic polypeptide
EVQLLESGGGLVQPGGSLRLSCAASGFTFSRNAMSWVRQAPGKGLEWVSATGGSGISTYYADSVKGRFTISRDNSKNTLYLQMNSLRAEDTAVYYCARGYSNSWWYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKCLEWISYISSSESIIYYVDSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKR

SEQ ID NO: 306 - protein, 217 aa, Artificial Sequence; identical to SEQ ID NO: 302
  Description of Artificial Sequence: Synthetic polypeptide

SEQ ID NO: 307 - DNA, 2109 bp, Artificial Sequence
  Description of Artificial Sequence: Synthetic polynucleotide
caggtgcaactggtgcagtctggggctgaagtgaagaagcctggggcctcagtgaaggtgtcctgcaaggcttctggatacaccttccccggctactatatgtactggttgcgacaggcccctggacaaggacttgagtggatgggatggatcaaccctgacagtggtgacacaaactatgcacagaagtttcagggcagggtcaccatgaccagggacacgtccatcagcacagcctttatggagctgagcaggctgagatcagacgacacggccgtgtattactgtgcgagagagaagcccagatattttgactccttctactactaccttatggacgtctggggccaagggaccacggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtcgagtctgggggaggcttggtcaagcctggagggtccctgagactctcctgtgcagcctctggattcaccttcagtgactactacatgacctggatcaggcaggctccagggaagtgcctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcaggagggggcggatctggcggcggaggaagcggtgggggcggctccgacattcagatgacccagtctccatcttccgtgtctgcatctgtaggggacagagtcaccatcacttgtcgggcgagtcagggtattaccaggtggttagcctggtatcagcagaaaccagggaaagcccctaagctcctgatctatgctgcatccgttttgcaaagtggggtcccatcaaggttcagcggcagtggatctgggacagatttcactctcaccatcagcagcctgcagcctgaagattttgcaacttactattgtcaacagtctaacagtttccctcggacgttcggctgcgggaccaaggtggaaatcaaacgg

SEQ ID NO: 308 - DNA, 642 bp, Artificial Sequence
  Description of Artificial Sequence: Synthetic polynucleotide
gacatccagatgacccagtctccatcctccctgtctgcatctgtaggagacagagtcaccatcacttgccgggcaggtcagaacattagcaggcatttaaattggtatcagcagaatccagggaaagcccctaaggtcctgatccatcctgcatccagtttgccaagtggggtcccgtcaaggttcagtggcagtggatctgggacagatttcagtcttaccatcagcagtctgcaacctgaagattttggaacttacttctgtcaacagagttacagtacccctcccactttcggcggagggaccaaggtggagctcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 309 - protein, 703 aa, Artificial Sequence
  Description of Artificial Sequence: Synthetic polypeptide
QVQLVQSGAEVKKPGASVKVSCKASGYTFPGYYMYWLRQAPGQGLEWMGWINPDSGDTNYAQKFQGRVTMTRDTSISTAFMELSRLRSDDTAVYYCAREKPRYFDSFYYYLMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMTWIRQAPGKCLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGCGTKVEIKR

SEQ ID NO: 310 - protein, 214 aa, Artificial Sequence
  Description of Artificial Sequence: Synthetic polypeptide
DIQMTQSPSSLSASVGDRVTITCRAGQNISRHLNWYQQNPGKAPKVLIHPASSLPSGVPSRFSGSGSGTDFSLTISSLQPEDFGTYFCQQSYSTPPTFGGGTKVELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 311 - DNA, 2109 bp, Artificial Sequence
  Description of Artificial Sequence: Synthetic polynucleotide
caggtgcaactggtgcagtctggggctgaagtgaagaagcctggggcctcagtgaaggtgtcctgcaaggcttctggatacaccttccccggctactatatgtactggttgcgacaggcccctggacaaggacttgagtggatgggatggatcaaccctgacagtggtgacacaaactatgcacagaagtttcagggcagggtcaccatgaccagggacacgtccatcagcacagcctttatggagctgagcaggctgagatcagacgacacggccgtgtattactgtgcgagagagaagcccagatattttgactccttctactactaccttatggacgtctggggccaagggaccacggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaagtgcctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcaggagggggcggatctggcggcggaggaagcggtgggggcggctccgacatccagatgacccagtctccatcttccgtgtctgcttctgtcggagacagagtcaccatcacttgtcgggcgagtcaggatattagcaggtggttagcctggtatcagcagaaaccagggaaagcccctaagctcctgatttctgctgcatccagattgcaaagtggagtcccatcaaggttcagcggcagtggatctgggacagatttcactctcaccatcagcagcctgcagcctgaagattttgcaatttactattgtcaacaggctaaaagttttcctcggacgttcggctgcgggaccaaggtggaaatcaaacgg

SEQ ID NO: 312 - DNA, 642 bp, Artificial Sequence; identical to SEQ ID NO: 308
  Description of Artificial Sequence: Synthetic polynucleotide

SEQ ID NO: 313 - protein, 703 aa, Artificial Sequence
  Description of Artificial Sequence: Synthetic polypeptide
QVQLVQSGAEVKKPGASVKVSCKASGYTFPGYYMYWLRQAPGQGLEWMGWINPDSGDTNYAQKFQGRVTMTRDTSISTAFMELSRLRSDDTAVYYCAREKPRYFDSFYYYLMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKCLEWISYISSSESIIYYVDSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKR

SEQ ID NO: 314 - protein, 214 aa, Artificial Sequence; identical to SEQ ID NO: 310
  Description of Artificial Sequence: Synthetic polypeptide

SEQ ID NO: 315 - DNA, 2109 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagccatggcatgcactgggtccgccaacctccaggcaaggggctggagtgggtggcagttatctggtatgatggaagtaatgaatactatggagactccgtgaagggccgattcaccatctccagagacaattccaagaacacgctgtatctgcaaatgaacagcctgagagtcgaggacacggctgtgtattactgtacgagaggggggggccactggaactacgagggccactactatggtatggacgtctggggccaagggaccacggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtcgagtctgggggaggcttggtcaagcctggagggtccctgagactctcctgtgcagcctctggattcaccttcagtgactactacatgacctggatcaggcaggctccagggaagtgcctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcaggagggggcggatctggcggcggaggaagcggtgggggcggctccgacattcagatgacccagtctccatcttccgtgtctgcatctgtaggggacagagtcaccatcacttgtcgggcgagtcagggtattaccaggtggttagcctggtatcagcagaaaccagggaaagcccctaagctcctgatctatgctgcatccgttttgcaaagtggggtcccatcaaggttcagcggcagtggatctgggacagatttcactctcaccatcagcagcctgcagcctgaagattttgcaacttactattgtcaacagtctaacagtttccctcggacgttcggctgcgggaccaaggtggaaatcaaacgg

SEQ ID NO: 316 - DNA, 663 bp, Artificial Sequence
  Description of Artificial Sequence: Synthetic polynucleotide
caggctgtgccgactcagccctcttccctctctgcatctcctggagcatcagccagtctcacctgcaccttacgcagtggcatcaatgttggttcctccaggatctattggtaccagcagaagccagggagtcctccccagtttctcctgaggtacacatcagactcagataaattgcagggctctggagtccccagccgcttctctggatccaaagatgcttcggccaatgcaggacttttactcatctctgggctccagtctgaggatgaggctgactattactgtatgatttggcacagcagcgctgtggtattcggcggagggaccaaactgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 317 - protein, 703 aa, Artificial Sequence
  Description of Artificial Sequence: Synthetic polypeptide
QVQLVESGGGVVQPGRSLRLSCAASGFTFSSHGMHWVRQPPGKGLEWVAVIWYDGSNEYYGDSVKGRFTISRDNSKNTLYLQMNSLRVEDTAVYYCTRGGGHWNYEGHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMTWIRQAPGKCLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGCGTKVEIKR

SEQ ID NO: 318 - protein, 221 aa, Artificial Sequence
  Description of Artificial Sequence: Synthetic polypeptide
QAVPTQPSSLSASPGASASLTCTLRSGINVGSSRIYWYQQKPGSPPQFLLRYTSDSDKLQGSGVPSRFSGSKDASANAGLLLISGLQSEDEADYYCMIWHSSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 319 - DNA, 2109 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagccatggcatgcactgggtccgccaacctccaggcaaggggctggagtgggtggcagttatctggtatgatggaagtaatgaatactatggagactccgtgaagggccgattcaccatctccagagacaattccaagaacacgctgtatctgcaaatgaacagcctgagagtcgaggacacggctgtgtattactgtacgagaggggggggccactggaactacgagggccactactatggtatggacgtctggggccaagggaccacggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaagtgcctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcaggagggggcggatctggcggcggaggaagcggtgggggcggctccgacatccagatgacccagtctccatcttccgtgtctgcttctgtcggagacagagtcaccatcacttgtcgggcgagtcaggatattagcaggtggttagcctggtatcagcagaaaccagggaaagcccctaagctcctgatttctgctgcatccagattgcaaagtggagtcccatcaaggttcagcggcagtggatctgggacagatttcactctcaccatcagcagcctgcagcctgaagattttgcaatttactattgtcaacaggctaaaagttttcctcggacgttcggctgcgggaccaaggtggaaatcaaacgg

SEQ ID NO: 320 - DNA, 663 bp, Artificial Sequence; identical to SEQ ID NO: 316
  Description of Artificial Sequence: Synthetic polynucleotide

SEQ ID NO: 321 - protein, 703 aa, Artificial Sequence
  Description of Artificial Sequence: Synthetic polypeptide
QVQLVESGGGVVQPGRSLRLSCAASGFTFSSHGMHWVRQPPGKGLEWVAVIWYDGSNEYYGDSVKGRFTISRDNSKNTLYLQMNSLRVEDTAVYYCTRGGGHWNYEGHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKCLEWISYISSSESIIYYVDSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKR

SEQ ID NO: 322 - protein, 221 aa, Artificial Sequence; identical to SEQ ID NO: 318
  Description of Artificial Sequence: Synthetic polypeptide

SEQ ID NO: 323 - DNA, 2091 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccctcagtagctatggcatgcactgggtccgccaggctccaggcaaggggctggagtgggtggcagttatctggtatgatggaagtaataaatactatgcagactccgtgaagggccgagtcaccatctccagagacaattccaagaacacgctgtatctgcaaatgaatagcctgagagccgaggacacggctgtgtattactgtacgagagatggccggaactacgtctactttgacaactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtcgagtctgggggaggcttggtcaagcctggagggtccctgagactctcctgtgcagcctctggattcaccttcagtgactactacatgacctggatcaggcaggctccagggaagtgcctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcaggagggggcggatctggcggcggaggaagcggtgggggcggctccgacattcagatgacccagtctccatcttccgtgtctgcatctgtaggggacagagtcaccatcacttgtcgggcgagtcagggtattaccaggtggttagcctggtatcagcagaaaccagggaaagcccctaagctcctgatctatgctgcatccgttttgcaaagtggggtcccatcaaggttcagcggcagtggatctgggacagatttcactctcaccatcagcagcctgcagcctgaagattttgcaacttactattgtcaacagtctaacagtttccctcggacgttcggctgcgggaccaaggtggaaatcaaacgg

SEQ ID NO: 324 - DNA, 648 bp, Artificial Sequence
  Description of Artificial Sequence: Synthetic polynucleotide
cagtctgccctgactcagcctcgctcagtgtccgggagccctggacagtcagtcaccatctcctgcactggaaccagcagtgatgttggtggttatatctttgtctcctggtaccaacaacacccaggcaaagcccccaaactcatgatttatgatgtcagtaagcggccctctggggtccctgatcgcttctctggctccaagtctgtcaacacggcctccctgaccatctctgggctccaggctgaggatgagactgattattactgctgctcatatgcaggcaactacacttatgtcttcggaactgggaccaaggtcaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 325 - protein, 697 aa, Artificial Sequence
  Description of Artificial Sequence: Synthetic polypeptide
QVQLVESGGGVVQPGRSLRLSCAASGFTLSSYGMHWVRQAPGKGLEWVAVIWYDGSNKYYADSVKGRVTISRDNSKNTLYLQMNSLRAEDTAVYYCTRDGRNYVYFDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMTWIRQAPGKCLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGCGTKVEIKR

SEQ ID NO: 326 - protein, 216 aa, Artificial Sequence
  Description of Artificial Sequence: Synthetic polypeptide
QSALTQPRSVSGSPGQSVTISCTGTSSDVGGYIFVSWYQQHPGKAPKLMIYDVSKRPSGVPDRFSGSKSVNTASLTISGLQAEDETDYYCCSYAGNYTYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 327 - DNA, 2091 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccctcagtagctatggcatgcactgggtccgccaggctccaggcaaggggctggagtgggtggcagttatctggtatgatggaagtaataaatactatgcagactccgtgaagggccgagtcaccatctccagagacaattccaagaacacgctgtatctgcaaatgaatagcctgagagccgaggacacggctgtgtattactgtacgagagatggccggaactacgtctactttgacaactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaagtgcctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcaggagggggcggatctggcggcggaggaagcggtgggggcggctccgacatccagatgacccagtctccatcttccgtgtctgcttctgtcggagacagagtcaccatcacttgtcgggcgagtcaggatattagcaggtggttagcctggtatcagcagaaaccagggaaagcccctaagctcctgatttctgctgcatccagattgcaaagtggagtcccatcaaggttcagcggcagtggatctgggacagatttcactctcaccatcagcagcctgcagcctgaagattttgcaatttactattgtcaacaggctaaaagttttcctcggacgttcggctgcgggaccaaggtggaaatcaaacgg

SEQ ID NO: 328 - DNA, 648 bp, Artificial Sequence; identical to SEQ ID NO: 324
  Description of Artificial Sequence: Synthetic polynucleotide

SEQ ID NO: 329 - protein, 697 aa, Artificial Sequence
  Description of Artificial Sequence: Synthetic polypeptide
QVQLVESGGGVVQPGRSLRLSCAASGFTLSSYGMHWVRQAPGKGLEWVAVIWYDGSNKYYADSVKGRVTISRDNSKNTLYLQMNSLRAEDTAVYYCTRDGRNYVYFDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKCLEWISYISSSESIIYYVDSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKR

SEQ ID NO: 330 - protein, 216 aa, Artificial Sequence; identical to SEQ ID NO: 326
  Description of Artificial Sequence: Synthetic polypeptide

SEQ ID NO: 331 - DNA, 2091 bp, Artificial Sequence
  Description of Artificial Sequence: Synthetic polynucleotide
caggtacagctgcaacagtcaggtccaggactggtgaagccctcgcagaccctctcactcacctgtgccatctccggggacagtgtctctagcagccgtactgcttggaactggatcaggcagtccccatcgagaggccttgagtggctgggaaggacatactacaggtccaagtggtatcatgattattcagtatctgtgaaaagtcgaatcaccatcgacccagacacatccaagaaccagttctccctgcagctgaactctgtgactcccgaggacacggctgtttattattgtgcaagaggggctgctccctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtcgagtctgggggaggcttggtcaagcctggagggtccctgagactctcctgtgcagcctctggattcaccttcagtgactactacatgacctggatcaggcaggctccagggaagtgcctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcaggagggggcggatctggcggcggaggaagcggtgggggcggctccgacattcagatgacccagtctccatcttccgtgtctgcatctgtaggggacagagtcaccatcacttgtcgggcgagtcagggtattaccaggtggttagcctggtatcagcagaaaccagggaaagcccctaagctcctgatctatgctgcatccgttttgcaaagtggggtcccatcaaggttcagcggcagtggatctgggacagatttcactctcaccatcagcagcctgcagcctgaagattttgcaacttactattgtcaacagtctaacagtttccctcggacgttcggctgcgggaccaaggtggaaatcaaacgg

SEQ ID NO: 332 - DNA, 645 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagcaactacttagcctggtaccaacagaaacctggccaggctcccagggcccttatctatgctgcatccaacagggccgctggcatctcagacaggttcagtggcagtgggtctgggacagacttcactctcaccatcagcagactggagcctgaagattttgcagtgtatttctgtcagcagtatggtagctcaccgctcactttcggcggagggactaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 333 - protein, 697 aa, Artificial Sequence
  Description of Artificial Sequence: Synthetic polypeptide
QVQLQQSGPGLVKPSQTLSLTCAISGDSVSSSRTAWNWIRQSPSRGLEWLGRTYYRSKWYHDYSVSVKSRITIDPDTSKNQFSLQLNSVTPEDTAVYYCARGAAPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMTWIRQAPGKCLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGCGTKVEIKR

SEQ ID NO: 334 - protein, 215 aa, Artificial Sequence
  Description of Artificial Sequence: Synthetic polypeptide
EIVLTQSPGTLSLSPGERATLSCRASQSVSSNYLAWYQQKPGQAPRALIYAASNRAAGISDRFSGSGSGTDFTLTISRLEPEDFAVYFCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 335 - DNA, 2091 bp, Artificial Sequence
  Description of Artificial Sequence: Synthetic polynucleotide
caggtacagctgcaacagtcaggtccaggactggtgaagccctcgcagaccctctcactcacctgtgccatctccggggacagtgtctctagcagccgtactgcttggaactggatcaggcagtccccatcgagaggccttgagtggctgggaaggacatactacaggtccaagtggtatcatgattattcagtatctgtgaaaagtcgaatcaccatcgacccagacacatccaagaaccagttctccctgcagctgaactctgtgactcccgaggacacggctgtttattattgtgcaagaggggctgctccctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaagtgcctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcaggagggggcggatctggcggcggaggaagcggtgggggcggctccgacatccagatgacccagtctccatcttccgtgtctgcttctgtcggagacagagtcaccatcacttgtcgggcgagtcaggatattagcaggtggttagcctggtatcagcagaaaccagggaaagcccctaagctcctgatttctgctgcatccagattgcaaagtggagtcccatcaaggttcagcggcagtggatctgggacagatttcactctcaccatcagcagcctgcagcctgaagattttgcaatttactattgtcaacaggctaaaagttttcctcggacgttcggctgcgggaccaaggtggaaatcaaacgg

SEQ ID NO: 336 - DNA, 645 bp, Artificial Sequence; identical to SEQ ID NO: 332
  Description of Artificial Sequence: Synthetic polynucleotide

SEQ ID NO: 337 - protein, 697 aa, Artificial Sequence
  Description of Artificial Sequence: Synthetic polypeptide
QVQLQQSGPGLVKPSQTLSLTCAISGDSVSSSRTAWNWIRQSPSRGLEWLGRTYYRSKWYHDYSVSVKSRITIDPDTSKNQFSLQLNSVTPEDTAVYYCARGAAPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKCLEWISYISSSESIIYYVDSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKR

SEQ ID NO: 338 - protein, 215 aa, Artificial Sequence; identical to SEQ ID NO: 334
  Description of Artificial Sequence: Synthetic polypeptide

SEQ ID NO: 339 - DNA, 2097 bp, Artificial Sequence
  Description of Artificial Sequence: Synthetic polynucleotide
caggtgcagttggtggagtctgggggaggcttagtcaagcctggagggtccctgagactctcctgtgcagcctctgaattcaccttcagtgactactacatgagctggatccgccaggctccagggaaggggctggagtgggtttcatatattagtcgaagtggtgataccatctactacgcagactctgtgaagggccgattcaccatctccagggacaacgccaagaactcactgtatctgcaaatgaatggcctgcgagccgaagacacggccgtgtattactgtgcgagagacttagcagcaggtgctacagggggccttgactgctggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtcgagtctgggggaggcttggtcaagcctggagggtccctgagactctcctgtgcagcctctggattcaccttcagtgactactacatgacctggatcaggcaggctccagggaagtgcctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcaggagggggcggatctggcggcggaggaagcggtgggggcggctccgacattcagatgacccagtctccatcttccgtgtctgcatctgtaggggacagagtcaccatcacttgtcgggcgagtcagggtattaccaggtggttagcctggtatcagcagaaaccagggaaagcccctaagctcctgatctatgctgcatccgttttgcaaagtggggtcccatcaaggttcagcggcagtggatctgggacagatttcactctcaccatcagcagcctgcagcctgaagattttgcaacttactattgtcaacagtctaacagtttccctcggacgttcggctgcgggaccaaggtggaaatcaaacgg

SEQ ID NO: 340 - DNA, 636 bp, Artificial Sequence
  Description of Artificial Sequence: Synthetic polynucleotide
tcctatgagctgactcagccaccctcagtgtccgtgtccccaggacagacagccagcatcacctgctctggagaaaggttgggaaataaatatatttgctggtatcagcagaagccaggccagtcccctgttctggtcatctatcaagatttcaagcggccctcagggatccctgagcgattctctggctccaactctgggatcacagccactctgaccatcagcgggacccaggctatggatgaggctgactattactgtcaggcgtgggacagcagaactgtggtattcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 341 - protein, 699 aa, Artificial Sequence
  Description of Artificial Sequence: Synthetic polypeptide
QVQLVESGGGLVKPGGSLRLSCAASEFTFSDYYMSWIRQAPGKGLEWVSYISRSGDTIYYADSVKGRFTISRDNAKNSLYLQMNGLRAEDTAVYYCARDLAAGATGGLDCWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMTWIRQAPGKCLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGCGTKVEIKR

SEQ ID NO: 342 - protein, 212 aa, Artificial Sequence
  Description of Artificial Sequence: Synthetic polypeptide
SYELTQPPSVSVSPGQTASITCSGERLGNKYICWYQQKPGQSPVLVIYQDFKRPSGIPERFSGSNSGITATLTISGTQAMDEADYYCQAWDSRTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 343 - DNA, 2097 bp, Artificial Sequence
  Description of Artificial Sequence: Synthetic polynucleotide
caggtgcagttggtggagtctgggggaggcttagtcaagcctggagggtccctgagactctcctgtgcagcctctgaattcaccttcagtgactactacatgagctggatccgccaggctccagggaaggggctggagtgggtttcatatattagtcgaagtggtgataccatctactacgcagactctgtgaagggccgattcaccatctccagggacaacgccaagaactcactgtatctgcaaatgaatggcctgcgagccgaagacacggccgtgtattactgtgcgagagacttagcagcaggtgctacagggggccttgactgctggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaagtgcctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcaggagggggcggatctggcggcggaggaagcggtgggggcggctccgacatccagatgacccagtctccatcttccgtgtctgcttctgtcggagacagagtcaccatcacttgtcgggcgagtcaggatattagcaggtggttagcctggtatcagcagaaaccagggaaagcccctaagctcctgatttctgctgcatccagattgcaaagtggagtcccatcaaggttcagcggcagtggatctgggacagatttcactctcaccatcagcagcctgcagcctgaagattttgcaatttactattgtcaacaggctaaaagttttcctcggacgttcggctgcgggaccaaggtggaaatcaaacgg

SEQ ID NO: 344 - DNA, 636 bp, Artificial Sequence; identical to SEQ ID NO: 340
  Description of Artificial Sequence: Synthetic polynucleotide

SEQ ID NO: 345 - protein, 699 aa, Artificial Sequence
  Description of Artificial Sequence: Synthetic polypeptide
QVQLVESGGGLVKPGGSLRLSCAASEFTFSDYYMSWIRQAPGKGLEWVSYISRSGDTIYYADSVKGRFTISRDNAKNSLYLQMNGLRAEDTAVYYCARDLAAGATGGLDCWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKCLEWISYISSSESIIYYVDSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKR

SEQ ID NO: 346 - protein, 212 aa, Artificial Sequence; identical to SEQ ID NO: 342
  Description of Artificial Sequence: Synthetic polypeptide

SEQ ID NO: 347 - DNA, 2097 bp, Artificial Sequence
  Description of Artificial Sequence: Synthetic polynucleotide
caggtgcagctggtgcagtctgggactgaggtgaagaagcctggggcctcagtgaaggtgtcctgcaaggcttctggatacaccttccccggctactatatgcactgggtgcgacaggcccctggacaggggcttgagtggatgggatggatcaaccctgacagtggtggcacaaagtatacacagaagtttcagggcagggtcaccttgaccagggacgcgtccgtcagcacagcctacattgacctgaacaggctgagatctgacgacacggccgtatattactgtgcgagagagaggtgtaggactaccaactgctatttggactactggggccagggaagtctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtcgagtctgggggaggcttggtcaagcctggagggtccctgagactctcctgtgcagcctctggattcaccttcagtgactactacatgacctggatcaggcaggctccagggaagtgcctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcaggagggggcggatctggcggcggaggaagcggtgggggcggctccgacattcagatgacccagtctccatcttccgtgtctgcatctgtaggggacagagtcaccatcacttgtcgggcgagtcagggtattaccaggtggttagcctggtatcagcagaaaccagggaaagcccctaagctcctgatctatgctgcatccgttttgcaaagtggggtcccatcaaggttcagcggcagtggatctgggacagatttcactctcaccatcagcagcctgcagcctgaagattttgcaacttactattgtcaacagtctaacagtttccctcggacgttcggctgcgggaccaaggtggaaatcaaacgg

SEQ ID NO: 348 - DNA, 651 bp, Artificial Sequence
  Description of Artificial Sequence: Synthetic polynucleotide
cagtctgccctgactcagcctgcctccgtgtctgggagccctggacagtcgatcaccatctcctgcactggaaccagcagtgatgttgggaattataaccttgtctcctggtaccaacagcacccaggcaaagcccccaaactcatgatttatgaggtcaataggcggccctcaggggtttctaatcgcttctctggctccaagtctggcaacacggcctccctgacaatctctgggctccaggctgaggacgaggctgaatattactgctgctcatatgcaggtagagacactttcgtggtgttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 349 - protein, 699 aa, Artificial Sequence
  Description of Artificial Sequence: Synthetic polypeptide
QVQLVQSGTEVKKPGASVKVSCKASGYTFPGYYMHWVRQAPGQGLEWMGWINPDSGGTKYTQKFQGRVTLTRDASVSTAYIDLNRLRSDDTAVYYCARERCRTTNCYLDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMTWIRQAPGKCLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGCGTKVEIKR

SEQ ID NO: 350 - protein, 217 aa, Artificial Sequence
  Description of Artificial Sequence: Synthetic polypeptide
QSALTQPASVSGSPGQSITISCTGTSSDVGNYNLVSWYQQHPGKAPKLMIYEVNRRPSGVSNRFSGSKSGNTASLTISGLQAEDEAEYYCCSYAGRDTFVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 351 - DNA, 2097 bp, Artificial Sequence
  Description of Artificial Sequence: Synthetic polynucleotide
caggtgcagctggtgcagtctgggactgaggtgaagaagcctggggcctcagtgaaggtgtcctgcaaggcttctggatacaccttccccggctactatatgcactgggtgcgacaggcccctggacaggggcttgagtggatgggatggatcaaccctgacagtggtggcacaaagtatacacagaagtttcagggcagggtcaccttgaccagggacgcgtccgtcagcacagcctacattgacctgaacaggctgagatctgacgacacggccgtatattactgtgcgagagagaggtgtaggactaccaactgctatttggactactggggccagggaagtctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaagtgcctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcaggagggggcggatctggcggcggaggaagcggtgggggcggctccgacatccagatgacccagtctccatcttccgtgtctgcttctgtcggagacagagtcaccatcacttgtcgggcgagtcaggatattagcaggtggttagcctggtatcagcagaaaccagggaaagcccctaagctcctgatttctgctgcatccagattgcaaagtggagtcccatcaaggttcagcggcagtggatctgggacagatttcactctcaccatcagcagcctgcagcctgaagattttgcaatttactattgtcaacaggctaaaagttttcctcggacgttcggctgcgggaccaaggtggaaatcaaacgg

SEQ ID NO: 352 - DNA, 651 bp, Artificial Sequence; identical to SEQ ID NO: 348
  Description of Artificial Sequence: Synthetic polynucleotide

SEQ ID NO: 353 - protein, 699 aa, Artificial Sequence
  Description of Artificial Sequence: Synthetic polypeptide
QVQLVQSGTEVKKPGASVKVSCKASGYTFPGYYMHWVRQAPGQGLEWMGWINPDSGGTKYTQKFQGRVTLTRDASVSTAYIDLNRLRSDDTAVYYCARERCRTTNCYLDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKCLEWISYISSSESIIYYVDSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKR

SEQ ID NO: 354 - protein, 217 aa, Artificial Sequence; identical to SEQ ID NO: 350
  Description of Artificial Sequence: Synthetic polypeptide

SEQ ID NO: 355 - DNA, 2091 bp, Artificial Sequence
  Description of Artificial Sequence: Synthetic polynucleotide
caggtacagctgcaacagtcaggtccaggactggtgaagccctcgcagaccctctcactcacctgtgccatctccggggacagtgtctctagcagccgtactgcttggaactggatcaggcagtccccatcgagaggccttgagtggctgggaaggacatactacaggtccaagtggtatcatgattattcagtatctgtgaaaagtcgaatcaccatcgacccagacacatccaagaaccagttctccctgcagctgaactctgtgactcccgaggacacggctgtttattattgtgcaagaggggctgctccctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaagtgcctggagtggatttcatacattagtagcagtgaaagtatcatctattacgtagacgctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcaggagggggcggatctggcggcggaggaagcggtgggggcggctccgacatccagatgacccagtctccatcttccgtgtctgcttctgtcggagacagagtcaccatcacttgtcgggcgagtcaggatattagcaggtggttagcctggtatcagcagaaaccagggaaagcccctaagctcctgatttctgctgcatccagattgcaaagtggagtcccatcaaggttcagcggcagtggatctgggacagatttcactctcaccatcagcagcctgcagcctgaagattttgcaatttactattgtcaacaggctaaaagttttcctcggacgttcggctgcgggaccaaggtggaaatcaaacgg

SEQ ID NO: 356 - DNA, 651 bp, Artificial Sequence
  Description of Artificial Sequence: Synthetic polynucleotide
cagtctgccctgactcagcctgcctccgtgtctgggagccctggacagtcgatcaccatctcctgcactggaaccagcagtgatgttgggaattataaccttgtctcctggtaccaacagcacccaggcaaagcccccaaactcatgatttatgaggtcaataggcggccctcaggggtttctaatcgcttctctggctccaagtctggcaacacggcctccctgacaatctctgggctccaggctgaggacgaggctgaatattactgctcctcatatgcaggtagagacactttcgtggtgttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 357 - protein, 697 aa, Artificial Sequence
  Description of Artificial Sequence: Synthetic polypeptide
QVQLQQSGPGLVKPSQTLSLTCAISGDSVSSSRTAWNWIRQSPSRGLEWLGRTYYRSKWYHDYSVSVKSRITIDPDTSKNQFSLQLNSVTPEDTAVYYCARGAAPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKCLEWISYISSSESIIYYVDAVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKR

SEQ ID NO: 358 - protein, 217 aa, Artificial Sequence
  Description of Artificial Sequence: Synthetic polypeptide
QSALTQPASVSGSPGQSITISCTGTSSDVGNYNLVSWYQQHPGKAPKLMIYEVNRRPSGVSNRFSGSKSGNTASLTISGLQAEDEAEYYCSSYAGRDTFVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 359 - DNA, 2109 bp, Artificial Sequence; identical to SEQ ID NO: 291
  Description of Artificial Sequence: Synthetic polynucleotide

SEQ ID NO: 360 - DNA, 642 bp, Artificial Sequence; identical to SEQ ID NO: 292
  Description of Artificial Sequence: Synthetic polynucleotide

SEQ ID NO: 361 - protein, 703 aa, Artificial Sequence; identical to SEQ ID NO: 293
  Description of Artificial Sequence: Synthetic polypeptide

SEQ ID NO: 362 - protein, 214 aa, Artificial Sequence; identical to SEQ ID NO: 294
  Description of Artificial Sequence: Synthetic polypeptide

SEQ ID NO: 363 - DNA, 2109 bp, Artificial Sequence
  Description of Artificial Sequence: Synthetic polynucleotide
caggtgcaactggtgcagtctggggctgaggtgacgaagcctggggcctcagtgaaggtgtcctgcaaggcttctggatacaccttcgccggctactatatgcactgggtgcgacaggcccctggacaagggcttgagtggatgggatggatcaaccctcacagtggtggcacaaactatgcacagaagtttcaggacagggtcaccatgaccagggacacgtccatcaacacagcctacatggaactgagcaggctgagatctgacgacacggccgtgtattactgtgcgagagaacgtatttctatggttcggggagtcgggcacaactggttcgccccctggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtcgagtctgggggaggcttggtcaagcctggagggtccctgagactctcctgtgcagcctctggattcaccttcagtgactactacatgacctggatcaggcaggctccagggaagtgcctggagtggatttcatacattagtagtagtggtagtaccatctactacgcagaatctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcaggagggggcggatctggcggcggaggaagcggtgggggcggctccgacattcagatgacccagtctccatcttccgtgtctgcatctgtaggggacagagtcaccatcacttgtcgggcgagtcagggtattaccaggtggttagcctggtatcagcagaaaccagggaaagcccctaagctcctgatctatgctgcatccgttttgcaaagtggggtcccatcaaggttcagcggcagtggatctgggacagatttcactctcaccatcagcagcctgcagcctgaagattttgcaacttactattgtcaacagtctaacagtttccctcggacgttcggctgcgggaccaaggtggaaatcaaacgg

SEQ ID NO: 364 - DNA, 642 bp, Artificial Sequence; identical to SEQ ID NO: 292
  Description of Artificial Sequence: Synthetic polynucleotide

SEQ ID NO: 365 - protein, 703 aa, Artificial Sequence
  Description of Artificial Sequence: Synthetic polypeptide
QVQLVQSGAEVTKPGASVKVSCKASGYTFAGYYMHWVRQAPGQGLEWMGWINPHSGGTNYAQKFQDRVTMTRDTSINTAYMELSRLRSDDTAVYYCARERISMVRGVGHNWFAPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMTWIRQAPGKCLEWISYISSSGSTIYYAESVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGCGTKVEIKR

SEQ ID NO: 366 - protein, 214 aa, Artificial Sequence; identical to SEQ ID NO: 294
  Description of Artificial Sequence: Synthetic polypeptide

SEQ ID NO: 367 - DNA, 2094 bp, Artificial Sequence
  Description of Artificial Sequence: Synthetic polynucleotide
gaggtgcagctgctggagtctgggggaggcttggtacagcctggggggtccctgagactctcctgtgcagcctctggattcacctttagtagaaatgccatgagttgggtccgccaggctccagggaaggggctggagtgggtgtcagctactggtggtagtggtattagcacatactacgcagactccgtgaagggccggttcaccatctccagagacaattccaagaacacgctgtatctgcaaatgaacagtctgagagccgaggacacggccgtatattactgtgcgagaggttatagcaacagctggtggtactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaagtgcctggagtggatttcatacattagtagcagtgaaagtatcatctattacgtagacgctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcaggagggggcggatctggcggcggaggaagcggtgggggcggctccgacatccagatgacccagtctccatcttccgtgtctgcttctgtcggagacagagtcaccatcacttgtcgggcgagtcaggatattagcaggtggttagcctggtatcagcagaaaccagggaaagcccctaagctcctgatttctgctgcatccagattgcaaagtggagtcccatcaaggttcagcggcagtggatctgggacagatttcactctcaccatcagcagcctgcagcctgaagattttgcaatttactattgtcaacaggctaaaagttttcctcggacgttcggctgcgggaccaaggtggaaatcaaacgg

SEQ ID NO: 368 - DNA, 651 bp, Artificial Sequence
  Description of Artificial Sequence: Synthetic polynucleotide
cagtctgccctgactcagcctgcctccgtgtctgggagccctggacagtcgatcaccatctcctgcactggaaccagcagtgatgttgggaattataaccttgtctcctggtaccaacagcacccaggcaaagcccccaaactcatgatttttgaggtcaatcagcggccctcaggggtttctaatcgcttctctggctccaagtctggcaccacggcctccctgacaatctctgggctccaggctgcggacgaggctgattatttctgctcctcatatacaactagtagcacttatgtgatcttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 369 - protein, 698 aa, Artificial Sequence
  Description of Artificial Sequence: Synthetic polypeptide
EVQLLESGGGLVQPGGSLRLSCAASGFTFSRNAMSWVRQAPGKGLEWVSATGGSGISTYYADSVKGRFTISRDNSKNTLYLQMNSLRAEDTAVYYCARGYSNSWWYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKCLEWISYISSSESIIYYVDAVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKR

SEQ ID NO: 370 - protein, 217 aa, Artificial Sequence
  Description of Artificial Sequence: Synthetic polypeptide
QSALTQPASVSGSPGQSITISCTGTSSDVGNYNLVSWYQQHPGKAPKLMIFEVNQRPSGVSNRFSGSKSGTTASLTISGLQAADEADYFCSSYTTSSTYVIFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 371 - DNA, 2109 bp, Artificial Sequence
  Description of Artificial Sequence: Synthetic polynucleotide
caggtgcaactggtgcagtctggggctgaagtgaagaagcctggggcctcagtgaaggtgtcctgcaaggcttctggatacaccttccccggctactatatgtactggttgcgacaggcccctggacaaggacttgagtggatgggatggatcaaccctgacagtggtgacacaaactatgcacagaagtttcagggcagggtcaccatgaccagggacacgtccatcagcacagcctttatggagctgagcaggctgagatcagacgacacggccgtgtattactgtgcgagagagaagcccagatattttgactccttctactactaccttatggacgtctggggccaagggaccacggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaagtgcctggagtggatttcatacattagtagcagtgaaagtatcatctattacgtagacgctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcaggagggggcggatctggcggcggaggaagcggtgggggcggctccgacatccagatgacccagtctccatcttccgtgtctgcttctgtcggagacagagtcaccatcacttgtcgggcgagtcaggatattagcaggtggttagcctggtatcagcagaaaccagggaaagcccctaagctcctgatttctgctgcatccagattgcaaagtggagtcccatcaaggttcagcggcagtggatctgggacagatttcactctcaccatcagcagcctgcagcctgaagattttgcaatttactattgtcaacaggctaaaagttttcctcggacgttcggctgcgggaccaaggtggaaatcaaacgg

SEQ ID NO: 372 - DNA, 642 bp, Artificial Sequence
  Description of Artificial Sequence: Synthetic polynucleotide
gacatccagatgacccagtctccatcctccctgtctgcatctgtaggagacagagtcaccatcacttgccgggcaggtcagaacattgccaggcatttaaattggtatcagcagaatccagggaaagcccctaaggtcctgatccatcctgcatccagtttgccaagtggggtcccgtcaaggttcagtggcagtggatctgggacagatttcagtcttaccatcagcagtctgcaacctgaagattttggaacttacttctgtcaacagagttacagtacccctcccactttcggcggagggaccaaggtggagctcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 373 - protein, 703 aa, Artificial Sequence
  Description of Artificial Sequence: Synthetic polypeptide
QVQLVQSGAEVKKPGASVKVSCKASGYTFPGYYMYWLRQAPGQGLEWMGWINPDSGDTNYAQKFQGRVTMTRDTSISTAFMELSRLRSDDTAVYYCAREKPRYFDSFYYYLMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKCLEWISYISSSESIIYYVDAVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKR

SEQ ID NO: 374 - protein, 214 aa, Artificial Sequence
  Description of Artificial Sequence: Synthetic polypeptide
DIQMTQSPSSLSASVGDRVTITCRAGQNIARHLNWYQQNPGKAPKVLIHPASSLPSGVPSRFSGSGSGTDFSLTISSLQPEDFGTYFCQQSYSTPPTFGGGTKVELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 375 - DNA, 2091 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccctcagtagctatggcatgcactgggtccgccaggctccaggcaaggggctggagtgggtggcagttatctggtatgatggaagtaataaatactatgcagactccgtgaagggccgagtcaccatctccagagacaattccaagaacacgctgtatctgcaaatgaatagcctgagagccgaggacacggctgtgtattactgtacgagagatggccggaactacgtctactttgacaactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaagtgcctggagtggatttcatacattagtagcagtgaaagtatcatctattacgtagacgctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcaggagggggcggatctggcggcggaggaagcggtgggggcggctccgacatccagatgacccagtctccatcttccgtgtctgcttctgtcggagacagagtcaccatcacttgtcgggcgagtcaggatattagcaggtggttagcctggtatcagcagaaaccagggaaagcccctaagctcctgatttctgctgcatccagattgcaaagtggagtcccatcaaggttcagcggcagtggatctgggacagatttcactctcaccatcagcagcctgcagcctgaagattttgcaatttactattgtcaacaggctaaaagttttcctcggacgttcggctgcgggaccaaggtggaaatcaaacgg

SEQ ID NO: 376 - DNA, 648 bp, Artificial Sequence
  Description of Artificial Sequence: Synthetic polynucleotide
cagtctgccctgactcagcctcgctcagtgtccgggagccctggacagtcagtcaccatctcctgcactggaaccagcagtgatgttggtggttatatctttgtctcctggtaccaacaacacccaggcaaagcccccaaactcatgatttatgatgtcagtaagcggccctctggggtccctgatcgcttctctggctccaagtctgtcaacacggcctccctgaccatctctgggctccaggctgaggatgagactgattattactgctcctcatatgcaggcaactacgcttatgtcttcggaactgggaccaaggtcaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 377 - protein, 697 aa, Artificial Sequence
  Description of Artificial Sequence: Synthetic polypeptide
QVQLVESGGGVVQPGRSLRLSCAASGFTLSSYGMHWVRQAPGKGLEWVAVIWYDGSNKYYADSVKGRVTISRDNSKNTLYLQMNSLRAEDTAVYYCTRDGRNYVYFDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKCLEWISYISSSESIIYYVDAVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKR

SEQ ID NO: 378 - protein, 216 aa, Artificial Sequence
  Description of Artificial Sequence: Synthetic polypeptide
QSALTQPRSVSGSPGQSVTISCTGTSSDVGGYIFVSWYQQHPGKAPKLMIYDVSKRPSGVPDRFSGSKSVNTASLTISGLQAEDETDYYCSSYAGNYAYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 379 - DNA, 2097 bp, Artificial Sequence
  Description of Artificial Sequence: Synthetic polynucleotide
caggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtgcagtctggggctgaggtgaagaagcctggggcctcagtgaaggtgtcctgcaaggcttctggatacaccttcgccggctactatatgcactgggtgcgacaggcccctggacaatgccttgagtggatgggatggatcaaccctgacagtggaggcacaaactttgcacagcagtttcagggcagggtcaccatgaccagggatacgtccatcagcacagcctacatggaggtgagcaggctgagatctgacgacacggccgtgttttactgtgcgagagagaagatcactatgactggtatttactttgactattggggccagggaaccctggtcaccgtgtcctcaggagggggcggatctggcggcggaggaagcggtgggggcggctccgacatccagatgacccagtctccatcctccctgtctgcatctgtaggagacattctcaccatcacttgccgggcaagtcagaacattaccacctatttaaattggtatcagcagaaaccagggaaagcccctaacctcctgatctctgctgcatcccgtttgcgaagtggggtcccatcaaggttcagtggcagtggatctgggacagatttcactctcaccatcagcagtctgcaacctgtagattttacaactttctactgtcaacagactttcactaccccgtggacgttcggctgcgggaccaaggtggagatcaaacga

SEQ ID NO: 380 - DNA, 642 bp, Artificial Sequence
  Description of Artificial Sequence: Synthetic polynucleotide
gacattcagatgacccagtctccatcttccgtgtctgcatctgtaggggacagagtcaccatcacttgtcgggcgagtcagggtattaccaggtggttagcctggtatcagcagaaaccagggaaagcccctaagctcctgatctatgctgcatccgttttgcaaagtggggtcccatcaaggttcagcggcagtggatctgggacagatttcactctcaccatcagcagcctgcagcctgaagattttgcaacttactattgtcaacagtctaacagtttccctcggacgttcggccaagggaccaaggtggaaatcaaacggacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 381 - protein, 699 aa, Artificial Sequence
  Description of Artificial Sequence: Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGAEVKKPGASVKVSCKASGYTFAGYYMHWVRQAPGQCLEWMGWINPDSGGTNFAQQFQGRVTMTRDTSISTAYMEVSRLRSDDTAVFYCAREKITMTGIYFDYWGQGTLVTVSSGGGGSGGGGSGGGGSDIQMTQSPSSLSASVGDILTITCRASQNITTYLNWYQQKPGKAPNLLISAASRLRSGVPSRFSGSGSGTDFTLTISSLQPVDFTTFYCQQTFTTPWTFGCGTKVEIKR

SEQ ID NO: 382 - protein, 214 aa, Artificial Sequence
  Description of Artificial Sequence: Synthetic polypeptide
DIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 383 - DNA, 2109 bp, Artificial Sequence
  Description of Artificial Sequence: Synthetic polynucleotide
caggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcaactggtgcagtctggggctgaggtgacgaagcctggggcctcagtgaaggtgtcctgcaaggcttctggatacaccttcgccggctactatatgcactgggtgcgacaggcccctggacaatgccttgagtggatgggatggatcaaccctcacagtggtggcacaaactatgcacagaagtttcaggacagggtcaccatgaccagggacacgtccatcaacacagcctacatggaactgagcaggctgagatctgacgacacggccgtgtattactgtgcgagagaacgtatttctatggttcggggagtcgggcacaactggttcgccccctggggccagggaaccctggtcaccgtgtcctcaggagggggcggatctggcggcggaggaagcggtgggggcggctccgacatccagatgacccagtctccatcctcactgtctgcatctgtaggagacagagtcaccatcacctgtcgggcgagtcaggacattagcaataatttagcctggtttcagcagaaaccagggaaaccccctaagtccctgatgtatgctgcatccagtttgcacagtggagtcccatcaacgttcagcggcagtggatctgggacagatttcactttcaccatcagcagcctgcagcctgaagattttgcaacttattactgccaacagtataatagttaccctctcactttcggctgcgggaccaaggtggagatcagacga

SEQ ID NO: 384 - DNA, 642 bp, Artificial Sequence; identical to SEQ ID NO: 380
  Description of Artificial Sequence: Synthetic polynucleotide

SEQ ID NO: 385 - protein, 703 aa, Artificial Sequence
  Description of Artificial Sequence: Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGAEVTKPGASVKVSCKASGYTFAGYYMHWVRQAPGQCLEWMGWINPHSGGTNYAQKFQDRVTMTRDTSINTAYMELSRLRSDDTAVYYCARERISMVRGVGHNWFAPWGQGTLVTVSSGGGGSGGGGSGGGGSDIQMTQSPSSLSASVGDRVTITCRASQDISNNLAWFQQKPGKPPKSLMYAASSLHSGVPSTFSGSGSGTDFTFTISSLQPEDFATYYCQQYNSYPLTFGCGTKVEIRR

SEQ ID NO: 386 - protein, 214 aa, Artificial Sequence; identical to SEQ ID NO: 382
  Description of Artificial Sequence: Synthetic polypeptide

SEQ ID NO: 387 - DNA, 2106 bp, Artificial Sequence
  Description of Artificial Sequence: Synthetic polynucleotide
caggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctgctggagtctgggggaggcttggtacagcctggggggtccctgagactctcctgtgcagcctctggattcacctttagtagaaatgccatgagttgggtccgccaggctccagggaagtgcctggagtgggtgtcagctactggtggtagtggtattagcacatactacgcagactccgtgaagggccggttcaccatctccagagacaattccaagaacacgctgtatctgcaaatgaacagtctgagagccgaggacacggccgtatattactgtgcgagaggttatagcaacagctggtggtactttgactactggggccagggaaccctggtcaccgtgtcctcaggagggggcggatctggcggcggaggaagcggtgggggcggctcccagtctgccctgactcagcctgcctccgtgtctgggagccctggacagtcgatcaccatctcctgcactggaaccagcagtgatgttgggaattataaccttgtctcctggtaccaacagcacccaggcaaagcccccaaactcatgatttttgaggtcaatcagcggccctcaggggtttctaatcgcttctctggctccaagtctggcaccacggcctccctgacaatctctgggctccaggctgcggacgaggctgattatttctgctgctcatatacaactagtagcacttatgtgatcttcggctgcgggaccaagctgaccgtcctaggt

SEQ ID NO: 388 - DNA, 642 bp, Artificial Sequence; identical to SEQ ID NO: 380
  Description of Artificial Sequence: Synthetic polynucleotide

SEQ ID NO: 389 - protein, 702 aa, Artificial Sequence
  Description of Artificial Sequence: Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLLESGGGLVQPGGSLRLSCAASGFTFSRNAMSWVRQAPGKCLEWVSATGGSGISTYYADSVKGRFTISRDNSKNTLYLQMNSLRAEDTAVYYCARGYSNSWWYFDYWGQGTLVTVSSGGGGSGGGGSGGGGSQSALTQPASVSGSPGQSITISCTGTSSDVGNYNLVSWYQQHPGKAPKLMIFEVNQRPSGVSNRFSGSKSGTTASLTISGLQAADEADYFCCSYTTSSTYVIFGCGTKLTVLG

SEQ ID NO: 390 - protein, 214 aa, Artificial Sequence; identical to SEQ ID NO: 382
  Description of Artificial Sequence: Synthetic polypeptide

SEQ ID NO: 391 - DNA, 2109 bp, Artificial Sequence
  Description of Artificial Sequence: Synthetic polynucleotide
caggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcaactggtgcagtctggggctgaagtgaagaagcctggggcctcagtgaaggtgtcctgcaaggcttctggatacaccttccccggctactatatgtactggttgcgacaggcccctggacaatgccttgagtggatgggatggatcaaccctgacagtggtgacacaaactatgcacagaagtttcagggcagggtcaccatgaccagggacacgtccatcagcacagcctttatggagctgagcaggctgagatcagacgacacggccgtgtattactgtgcgagagagaagcccagatattttgactccttctactactaccttatggacgtctggggccaagggaccacggtcaccgtgtcctcaggagggggcggatctggcggcggaggaagcggtgggggcggctccgacatccagatgacccagtctccatcctccctgtctgcatctgtaggagacagagtcaccatcacttgccgggcaggtcagaacattagcaggcatttaaattggtatcagcagaatccagggaaagcccctaaggtcctgatccatcctgcatccagtttgccaagtggggtcccgtcaaggttcagtggcagtggatctgggacagatttcagtcttaccatcagcagtctgcaacctgaagattttggaacttacttctgtcaacagagttacagtacccctcccactttcggctgcgggaccaaggtggagctcaaacga

SEQ ID NO: 392 - DNA, 642 bp, Artificial Sequence; identical to SEQ ID NO: 380
  Description of Artificial Sequence: Synthetic polynucleotide

SEQ ID NO: 393 - protein, 703 aa, Artificial Sequence
  Description of Artificial Sequence: Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGAEVKKPGASVKVSCKASGYTFPGYYMYWLRQAPGQCLEWMGWINPDSGDTNYAQKFQGRVTMTRDTSISTAFMELSRLRSDDTAVYYCAREKPRYFDSFYYYLMDVWGQGTTVTVSSGGGGSGGGGSGGGGSDIQMTQSPSSLSASVGDRVTITCRAGQNISRHLNWYQQNPGKAPKVLIHPASSLPSGVPSRFSGSGSGTDFSLTISSLQPEDFGTYFCQQSYSTPPTFGCGTKVELKR

SEQ ID NO: 394 - protein, 214 aa, Artificial Sequence; identical to SEQ ID NO: 382
  Description of Artificial Sequence: Synthetic polypeptide

SEQ ID NO: 395 - DNA, 2133 bp, Artificial Sequence
  Description of Artificial Sequence: Synthetic polynucleotide
caggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttggtggagtctgggggaggcgtggtccagcctgggaggtccctgagactctcctgtgcagcgtctggattcaccttcagtagccatggcatgcactgggtccgccaacctccaggcaagtgcctggagtgggtggcagttatctggtatgatggaagtaatgaatactatggagactccgtgaagggccgattcaccatctccagagacaattccaagaacacgctgtatctgcaaatgaacagcctgagagtcgaggacacggctgtgtattactgtacgagaggggggggccactggaactacgagggccactactatggtatggacgtctggggccaagggaccacggtcaccgtgtcctcaggagggggcggatctggcggcggaggaagcggtgggggcggctcccaggctgtgccgactcagccctcttccctctctgcatctcctggagcatcagccagtctcacctgcaccttacgcagtggcatcaatgttggttcctccaggatctattggtaccagcagaagccagggagtcctccccagtttctcctgaggtacacatcagactcagataaattgcagggctctggagtccccagccgcttctctggatccaaagatgcttcggccaatgcaggacttttactcatctctgggctccagtctgaggatgaggctgactattactgtatgatttggcacagcagcgctgtggtattcggctgcgggaccaaactgaccgtcctaggt

SEQ ID NO: 396 - DNA, 642 bp, Artificial Sequence; identical to SEQ ID NO: 380
  Description of Artificial Sequence: Synthetic polynucleotide

SEQ ID NO: 397 - protein, 711 aa, Artificial Sequence
  Description of Artificial Sequence: Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSHGMHWVRQPPGKCLEWVAVIWYDGSNEYYGDSVKGRFTISRDNSKNTLYLQMNSLRVEDTAVYYCTRGGGHWNYEGHYYGMDVWGQGTTVTVSSGGGGSGGGGSGGGGSQAVPTQPSSLSASPGASASLTCTLRSGINVGSSRIYWYQQKPGSPPQFLLRYTSDSDKLQGSGVPSRFSGSKDASANAGLLLISGLQSEDEADYYCMIWHSSAVVFGCGTKLTVLG

SEQ ID NO: 398 - protein, 214 aa, Artificial Sequence; identical to SEQ ID NO: 382
  Description of Artificial Sequence: Synthetic polypeptide

SEQ ID NO: 399 - DNA, 2100 bp, Artificial Sequence
  Description of Artificial Sequence: Synthetic polynucleotide
caggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcgtggtccagcctgggaggtccctgagactctcctgtgcagcgtctggattcaccctcagtagctatggcatgcactgggtccgccaggctccaggcaagtgcctggagtgggtggcagttatctggtatgatggaagtaataaatactatgcagactccgtgaagggccgagtcaccatctccagagacaattccaagaacacgctgtatctgcaaatgaatagcctgagagccgaggacacggctgtgtattactgtacgagagatggccggaactacgtctactttgacaactggggccagggaaccctggtcaccgtgtcctcaggagggggcggatctggcggcggaggaagcggtgggggcggctcccagtctgccctgactcagcctcgctcagtgtccgggagccctggacagtcagtcaccatctcctgcactggaaccagcagtgatgttggtggttatatctttgtctcctggtaccaacaacacccaggcaaagcccccaaactcatgatttatgatgtcagtaagcggccctctggggtccctgatcgcttctctggctccaagtctgtcaacacggcctccctgaccatctctgggctccaggctgaggatgagactgattattactgctgctcatatgcaggcaactacacttatgtcttcggatgcgggaccaaggtcaccgtcctaggt

SEQ ID NO: 400 - DNA, 642 bp, Artificial Sequence; identical to SEQ ID NO: 380
  Description of Artificial Sequence: Synthetic polynucleotide

SEQ ID NO: 401 - protein, 700 aa, Artificial Sequence
  Description of Artificial Sequence: Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTLSSYGMHWVRQAPGKCLEWVAVIWYDGSNKYYADSVKGRVTISRDNSKNTLYLQMNSLRAEDTAVYYCTRDGRNYVYFDNWGQGTLVTVSSGGGGSGGGGSGGGGSQSALTQPRSVSGSPGQSVTISCTGTSSDVGGYIFVSWYQQHPGKAPKLMIYDVSKRPSGVPDRFSGSKSVNTASLTISGLQAEDETDYYCCSYAGNYTYVFGCGTKVTVLG

SEQ ID NO: 402 - protein, 214 aa, Artificial Sequence; identical to SEQ ID NO: 382
  Description of Artificial Sequence: Synthetic polypeptide

SEQ ID NO: 403 - DNA, 2094 bp, Artificial Sequence
  Description of Artificial Sequence: Synthetic polynucleotide
caggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagctgcaacagtcaggtccaggactggtgaagccctcgcagaccctctcactcacctgtgccatctccggggacagtgtctctagcagccgtactgcttggaactggatcaggcagtccccatcgagatgccttgagtggctgggaaggacatactacaggtccaagtggtatcatgattattcagtatctgtgaaaagtcgaatcaccatcgacccagacacatccaagaaccagttctccctgcagctgaactctgtgactcccgaggacacggctgtttattattgtgcaagaggggctgctccctttgactactggggccagggaaccctggtcaccgtgtcctcaggagggggcggatctggcggcggaggaagcggtgggggcggctccgaaattgtgttgacgcagtctccaggcaccctgtctttgtctccaggggaaagagccaccctctcctgcagggccagtcagagtgttagcagcaactacttagcctggtaccaacagaaacctggccaggctcccagggcccttatctatgctgcatccaacagggccgctggcatctcagacaggttcagtggcagtgggtctgggacagacttcactctcaccatcagcagactggagcctgaagattttgcagtgtatttctgtcagcagtatggtagctcaccgctcactttcggctgcgggactaaggtggagatcaaacga

SEQ ID NO: 404 - DNA, 642 bp, Artificial Sequence; identical to SEQ ID NO: 380
  Description of Artificial Sequence: Synthetic polynucleotide

SEQ ID NO: 405 - protein, 698 aa, Artificial Sequence
  Description of Artificial Sequence: Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGPGLVKPSQTLSLTCAISGDSVSSSRTAWNWIRQSPSRCLEWLGRTYYRSKWYHDYSVSVKSRITIDPDTSKNQFSLQLNSVTPEDTAVYYCARGAAPFDYWGQGTLVTVSSGGGGSGGGGSGGGGSEIVLTQSPGTLSLSPGERATLSCRASQSVSSNYLAWYQQKPGQAPRALIYAASNRAAGISDRFSGSGSGTDFTLTISRLEPEDFAVYFCQQYGSSPLTFGCGTKVEIKR

SEQ ID NO: 406 - protein, 214 aa, Artificial Sequence; identical to SEQ ID NO: 382
  Description of Artificial Sequence: Synthetic polypeptide

SEQ ID NO: 407 - DNA, 2094 bp, Artificial Sequence
  Description of Artificial Sequence: Synthetic polynucleotide
caggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttggtggagtctgggggaggcttagtcaagcctggagggtccctgagactctcctgtgcagcctctgaattcaccttcagtgactactacatgagctggatccgccaggctccagggaagtgcctggagtgggtttcatatattagtcgaagtggtgataccatctactacgcagactctgtgaagggccgattcaccatctccagggacaacgccaagaactcactgtatctgcaaatgaatggcctgcgagccgaagacacggccgtgtattactgtgcgagagacttagcagcaggtgctacagggggccttgactgctggggccagggaaccctggtcaccgtgtcctcaggagggggcggatctggcggcggaggaagcggtgggggcggctcctcctatgagctgactcagccaccctcagtgtccgtgtccccaggacagacagccagcatcacctgctctggagaaaggttgggaaataaatatatttgctggtatcagcagaagccaggccagtcccctgttctggtcatctatcaagatttcaagcggccctcagggatccctgagcgattctctggctccaactctgggatcacagccactctgaccatcagcgggacccaggctatggatgaggctgactattactgtcaggcgtgggacagcagaactgtggtattcggctgcgggaccaagctgaccgtcctaggt

SEQ ID NO: 408 - DNA, 642 bp, Artificial Sequence; identical to SEQ ID NO: 380
  Description of Artificial Sequence: Synthetic polynucleotide

SEQ ID NO: 409 - protein, 698 aa, Artificial Sequence
  Description of Artificial Sequence: Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASEFTFSDYYMSWIRQAPGKCLEWVSYISRSGDTIYYADSVKGRFTISRDNAKNSLYLQMNGLRAEDTAVYYCARDLAAGATGGLDCWGQGTLVTVSSGGGGSGGGGSGGGGSSYELTQPPSVSVSPGQTASITCSGERLGNKYICWYQQKPGQSPVLVIYQDFKRPSGIPERFSGSNSGITATLTISGTQAMDEADYYCQAWDSRTVVFGCGTKLTVLG

SEQ ID NO: 410 - protein, 214 aa, Artificial Sequence; identical to SEQ ID NO: 382
  Description of Artificial Sequence: Synthetic polypeptide

SEQ ID NO: 411 - DNA, 2109 bp, Artificial Sequence
  Description of Artificial Sequence: Synthetic polynucleotide
caggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtgcagtctgggactgaggtgaagaagcctggggcctcagtgaaggtgtcctgcaaggcttctggatacaccttccccggctactatatgcactgggtgcgacaggcccctggacagtgccttgagtggatgggatggatcaaccctgacagtggtggcacaaagtatacacagaagtttcagggcagggtcaccttgaccagggacgcgtccgtcagcacagcctacattgacctgaacaggctgagatctgacgacacggccgtatattactgtgcgagagagaggtgtaggactaccaactgctatttggactactggggccagggaagtctggtcaccgtgtcctcaggagggggcggatctggcggcggaggaagcggtgggggcggctcccagtctgccctgactcagcctgcctccgtgtctgggagccctggacagtcgatcaccatctcctgcactggaaccagcagtgatgttgggaattataaccttgtctcctggtaccaacagcacccaggcaaagcccccaaactcatgatttatgaggtcaataggcggccctcaggggtttctaatcgcttctctggctccaagtctggcaacacggcctccctgacaatctctgggctccaggctgaggacgaggctgaatattactgctgctcatatgcaggtagagacactttcgtggtgttcggctgcgggaccaagctgaccgtcctaggt

SEQ ID NO: 412 - DNA, 642 bp, Artificial Sequence; identical to SEQ ID NO: 380
  Description of Artificial Sequence: Synthetic polynucleotide

SEQ ID NO: 413 - protein, 703 aa, Artificial Sequence
  Description of Artificial Sequence: Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGTEVKKPGASVKVSCKASGYTFPGYYMHWVRQAPGQCLEWMGWINPDSGGTKYTQKFQGRVTLTRDASVSTAYIDLNRLRSDDTAVYYCARERCRTTNCYLDYWGQGSLVTVSSGGGGSGGGGSGGGGSQSALTQPASVSGSPGQSITISCTGTSSDVGNYNLVSWYQQHPGKAPKLMIYEVNRRPSGVSNRFSGSKSGNTASLTISGLQAEDEAEYYCCSYAGRDTFVVFGCGTKLTVLG

SEQ ID NO: 414 - protein, 214 aa, Artificial Sequence; identical to SEQ ID NO: 382
  Description of Artificial Sequence: Synthetic polypeptide

SEQ ID NO: 415 - DNA, 2097 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtgcagtctggggctgaggtgaagaagcctggggcctcagtgaaggtgtcctgcaaggcttctggatacaccttcgccggctactatatgcactgggtgcgacaggcccctggacaatgccttgagtggatgggatggatcaaccctgacagtggaggcacaaactttgcacagcagtttcagggcagggtcaccatgaccagggatacgtccatcagcacagcctacatggaggtgagcaggctgagatctgacgacacggccgtgttttactgtgcgagagagaagatcactatgactggtatttactttgactattggggccagggaaccctggtcaccgtgtcctcaggagggggcggatctggcggcggaggaagcggtgggggcggctccgacatccagatgacccagtctccatcctccctgtctgcatctgtaggagacattctcaccatcacttgccgggcaagtcagaacattaccacctatttaaattggtatcagcagaaaccagggaaagcccctaacctcctgatctctgctgcatcccgtttgcgaagtggggtcccatcaaggttcagtggcagtggatctgggacagatttcactctcaccatcagcagtctgcaacctgtagattttacaactttctactgtcaacagactttcactaccccgtggacgttcggctgcgggaccaaggtggagatcaaacga

SEQ ID NO: 416 - DNA, 642 bp, Artificial Sequence
  Description of Artificial Sequence: Synthetic polynucleotide
gacatccagatgacccagtctccatcttccgtgtctgcttctgtcggagacagagtcaccatcacttgtcgggcgagtcaggatattagcaggtggttagcctggtatcagcagaaaccagggaaagcccctaagctcctgatttctgctgcatccagattgcaaagtggagtcccatcaaggttcagcggcagtggatctgggacagatttcactctcaccatcagcagcctgcagcctgaagattttgcaatttactattgtcaacaggctaaaagttttcctcggacgttcggccaagggaccaaggtggaaatcaaacggacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 417 - protein, 699 aa, Artificial Sequence
  Description of Artificial Sequence: Synthetic polypeptide
QVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGAEVKKPGASVKVSCKASGYTFAGYYMHWVRQAPGQCLEWMGWINPDSGGTNFAQQFQGRVTMTRDTSISTAYMEVSRLRSDDTAVFYCAREKITMTGIYFDYWGQGTLVTVSSGGGGSGGGGSGGGGSDIQMTQSPSSLSASVGDILTITCRASQNITTYLNWYQQKPGKAPNLLISAASRLRSGVPSRFSGSGSGTDFTLTISSLQPVDFTTFYCQQTFTTPWTFGCGTKVEIKR

SEQ ID NO: 418 - protein, 214 aa, Artificial Sequence
  Description of Artificial Sequence: Synthetic polypeptide
DIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 419 - DNA, 2109 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcaactggtgcagtctggggctgaggtgacgaagcctggggcctcagtgaaggtgtcctgcaaggcttctggatacaccttcgccggctactatatgcactgggtgcgacaggcccctggacaatgccttgagtggatgggatggatcaaccctcacagtggtggcacaaactatgcacagaagtttcaggacagggtcaccatgaccagggacacgtccatcaacacagcctacatggaactgagcaggctgagatctgacgacacggccgtgtattactgtgcgagagaacgtatttctatggttcggggagtcgggcacaactggttcgccccctggggccagggaaccctggtcaccgtgtcctcaggagggggcggatctggcggcggaggaagcggtgggggcggctccgacatccagatgacccagtctccatcctcactgtctgcatctgtaggagacagagtcaccatcacctgtcgggcgagtcaggacattagcaataatttagcctggtttcagcagaaaccagggaaaccccctaagtccctgatgtatgctgcatccagtttgcacagtggagtcccatcaacgttcagcggcagtggatctgggacagatttcactttcaccatcagcagcctgcagcctgaagattttgcaacttattactgccaacagtataatagttaccctctcactttcggctgcgggaccaaggtggagatcagacga

SEQ ID NO: 420 - DNA, 642 bp, Artificial Sequence; identical to SEQ ID NO: 416
  Description of Artificial Sequence: Synthetic polynucleotide

SEQ ID NO: 421 - protein, 703 aa, Artificial Sequence
  Description of Artificial Sequence: Synthetic polypeptide
QVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGAEVTKPGASVKVSCKASGYTFAGYYMHWVRQAPGQCLEWMGWINPHSGGTNYAQKFQDRVTMTRDTSINTAYMELSRLRSDDTAVYYCARERISMVRGVGHNWFAPWGQGTLVTVSSGGGGSGGGGSGGGGSDIQMTQSPSSLSASVGDRVTITCRASQDISNNLAWFQQKPGKPPKSLMYAASSLHSGVPSTFSGSGSGTDFTFTISSLQPEDFATYYCQQYNSYPLTFGCGTKVEIRR

SEQ ID NO: 422 - protein, 214 aa, Artificial Sequence; identical to SEQ ID NO: 418
  Description of Artificial Sequence: Synthetic polypeptide

SEQ ID NO: 423 - DNA, 2106 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctgctggagtctgggggaggcttggtacagcctggggggtccctgagactctcctgtgcagcctctggattcacctttagtagaaatgccatgagttgggtccgccaggctccagggaagtgcctggagtgggtgtcagctactggtggtagtggtattagcacatactacgcagactccgtgaagggccggttcaccatctccagagacaattccaagaacacgctgtatctgcaaatgaacagtctgagagccgaggacacggccgtatattactgtgcgagaggttatagcaacagctggtggtactttgactactggggccagggaaccctggtcaccgtgtcctcaggagggggcggatctggcggcggaggaagcggtgggggcggctcccagtctgccctgactcagcctgcctccgtgtctgggagccctggacagtcgatcaccatctcctgcactggaaccagcagtgatgttgggaattataaccttgtctcctggtaccaacagcacccaggcaaagcccccaaactcatgatttttgaggtcaatcagcggccctcaggggtttctaatcgcttctctggctccaagtctggcaccacggcctccctgacaatctctgggctccaggctgcggacgaggctgattatttctgctgctcatatacaactagtagcacttatgtgatcttcggctgcgggaccaagctgaccgtcctaggt

SEQ ID NO: 424 - DNA, 642 bp, Artificial Sequence; identical to SEQ ID NO: 416
  Description of Artificial Sequence: Synthetic polynucleotide

SEQ ID NO: 425 - protein, 702 aa, Artificial Sequence
  Description of Artificial Sequence: Synthetic polypeptide
QVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLLESGGGLVQPGGSLRLSCAASGFTFSRNAMSWVRQAPGKCLEWVSATGGSGISTYYADSVKGRFTISRDNSKNTLYLQMNSLRAEDTAVYYCARGYSNSWWYFDYWGQGTLVTVSSGGGGSGGGGSGGGGSQSALTQPASVSGSPGQSITISCTGTSSDVGNYNLVSWYQQHPGKAPKLMIFEVNQRPSGVSNRFSGSKSGTTASLTISGLQAADEADYFCCSYTTSSTYVIFGCGTKLTVLG

SEQ ID NO: 426 - protein, 214 aa, Artificial Sequence; identical to SEQ ID NO: 418
  Description of Artificial Sequence: Synthetic polypeptide

SEQ ID NO: 427 - DNA, 2109 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcaactggtgcagtctggggctgaagtgaagaagcctggggcctcagtgaaggtgtcctgcaaggcttctggatacaccttccccggctactatatgtactggttgcgacaggcccctggacaatgccttgagtggatgggatggatcaaccctgacagtggtgacacaaactatgcacagaagtttcagggcagggtcaccatgaccagggacacgtccatcagcacagcctttatggagctgagcaggctgagatcagacgacacggccgtgtattactgtgcgagagagaagcccagatattttgactccttctactactaccttatggacgtctggggccaagggaccacggtcaccgtgtcctcaggagggggcggatctggcggcggaggaagcggtgggggcggctccgacatccagatgacccagtctccatcctccctgtctgcatctgtaggagacagagtcaccatcacttgccgggcaggtcagaacattagcaggcatttaaattggtatcagcagaatccagggaaagcccctaaggtcctgatccatcctgcatccagtttgccaagtggggtcccgtcaaggttcagtggcagtggatctgggacagatttcagtcttaccatcagcagtctgcaacctgaagattttggaacttacttctgtcaacagagttacagtacccctcccactttcggctgcgggaccaaggtggagctcaaacga

SEQ ID NO: 428 - DNA, 642 bp, Artificial Sequence; identical to SEQ ID NO: 416
  Description of Artificial Sequence: Synthetic polynucleotide

SEQ ID NO: 429 - protein, 703 aa, Artificial Sequence
  Description of Artificial Sequence: Synthetic polypeptide
QVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGAEVKKPGASVKVSCKASGYTFPGYYMYWLRQAPGQCLEWMGWINPDSGDTNYAQKFQGRVTMTRDTSISTAFMELSRLRSDDTAVYYCAREKPRYFDSFYYYLMDVWGQGTTVTVSSGGGGSGGGGSGGGGSDIQMTQSPSSLSASVGDRVTITCRAGQNISRHLNWYQQNPGKAPKVLIHPASSLPSGVPSRFSGSGSGTDFSLTISSLQPEDFGTYFCQQSYSTPPTFGCGTKVELKR

SEQ ID NO: 430 - protein, 214 aa, Artificial Sequence; identical to SEQ ID NO: 418
  Description of Artificial Sequence: Synthetic polypeptide

SEQ ID NO: 431 - DNA, 2133 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttggtggagtctgggggaggcgtggtccagcctgggaggtccctgagactctcctgtgcagcgtctggattcaccttcagtagccatggcatgcactgggtccgccaacctccaggcaagtgcctggagtgggtggcagttatctggtatgatggaagtaatgaatactatggagactccgtgaagggccgattcaccatctccagagacaattccaagaacacgctgtatctgcaaatgaacagcctgagagtcgaggacacggctgtgtattactgtacgagaggggggggccactggaactacgagggccactactatggtatggacgtctggggccaagggaccacggtcaccgtgtcctcaggagggggcggatctggcggcggaggaagcggtgggggcggctcccaggctgtgccgactcagccctcttccctctctgcatctcctggagcatcagccagtctcacctgcaccttacgcagtggcatcaatgttggttcctccaggatctattggtaccagcagaagccagggagtcctccccagtttctcctgaggtacacatcagactcagataaattgcagggctctggagtccccagccgcttctctggatccaaagatgcttcggccaatgcaggacttttactcatctctgggctccagtctgaggatgaggctgactattactgtatgatttggcacagcagcgctgtggtattcggctgcgggaccaaactgaccgtcctaggt

SEQ ID NO: 432 - DNA, 642 bp, Artificial Sequence; identical to SEQ ID NO: 416
  Description of Artificial Sequence: Synthetic polynucleotide

SEQ ID NO: 433 - protein, 711 aa, Artificial Sequence
  Description of Artificial Sequence: Synthetic polypeptide
QVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSHGMHWVRQPPGKCLEWVAVIWYDGSNEYYGDSVKGRFTISRDNSKNTLYLQMNSLRVEDTAVYYCTRGGGHWNYEGHYYGMDVWGQGTTVTVSSGGGGSGGGGSGGGGSQAVPTQPSSLSASPGASASLTCTLRSGINVGSSRIYWYQQKPGSPPQFLLRYTSDSDKLQGSGVPSRFSGSKDASANAGLLLISGLQSEDEADYYCMIWHSSAVVFGCGTKLTVLG

SEQ ID NO: 434 - protein, 214 aa, Artificial Sequence; identical to SEQ ID NO: 418
  Description of Artificial Sequence: Synthetic polypeptide

SEQ ID NO: 435 - DNA, 2100 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcgtggtccagcctgggaggtccctgagactctcctgtgcagcgtctggattcaccctcagtagctatggcatgcactgggtccgccaggctccaggcaagtgcctggagtgggtggcagttatctggtatgatggaagtaataaatactatgcagactccgtgaagggccgagtcaccatctccagagacaattccaagaacacgctgtatctgcaaatgaatagcctgagagccgaggacacggctgtgtattactgtacgagagatggccggaactacgtctactttgacaactggggccagggaaccctggtcaccgtgtcctcaggagggggcggatctggcggcggaggaagcggtgggggcggctcccagtctgccctgactcagcctcgctcagtgtccgggagccctggacagtcagtcaccatctcctgcactggaaccagcagtgatgttggtggttatatctttgtctcctggtaccaacaacacccaggcaaagcccccaaactcatgatttatgatgtcagtaagcggccctctggggtccctgatcgcttctctggctccaagtctgtcaacacggcctccctgaccatctctgggctccaggctgaggatgagactgattattactgctgctcatatgcaggcaactacacttatgtcttcggatgcgggaccaaggtcaccgtcctaggt

SEQ ID NO: 436 - DNA, 642 bp, Artificial Sequence; identical to SEQ ID NO: 416
  Description of Artificial Sequence: Synthetic polynucleotide

SEQ ID NO: 437 - protein, 700 aa, Artificial Sequence
  Description of Artificial Sequence: Synthetic polypeptide
QVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTLSSYGMHWVRQAPGKCLEWVAVIWYDGSNKYYADSVKGRVTISRDNSKNTLYLQMNSLRAEDTAVYYCTRDGRNYVYFDNWGQGTLVTVSSGGGGSGGGGSGGGGSQSALTQPRSVSGSPGQSVTISCTGTSSDVGGYIFVSWYQQHPGKAPKLMIYDVSKRPSGVPDRFSGSKSVNTASLTISGLQAEDETDYYCCSYAGNYTYVFGCGTKVTVLG

SEQ ID NO: 438 - protein, 214 aa, Artificial Sequence; identical to SEQ ID NO: 418
  Description of Artificial Sequence: Synthetic polypeptide

SEQ ID NO: 439 - DNA, 2094 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagctgcaacagtcaggtccaggactggtgaagccctcgcagaccctctcactcacctgtgccatctccggggacagtgtctctagcagccgtactgcttggaactggatcaggcagtccccatcgagatgccttgagtggctgggaaggacatactacaggtccaagtggtatcatgattattcagtatctgtgaaaagtcgaatcaccatcgacccagacacatccaagaaccagttctccctgcagctgaactctgtgactcccgaggacacggctgtttattattgtgcaagaggggctgctccctttgactactggggccagggaaccctggtcaccgtgtcctcaggagggggcggatctggcggcggaggaagcggtgggggcggctccgaaattgtgttgacgcagtctccaggcaccctgtctttgtctccaggggaaagagccaccctctcctgcagggccagtcagagtgttagcagcaactacttagcctggtaccaacagaaacctggccaggctcccagggcccttatctatgctgcatccaacagggccgctggcatctcagacaggttcagtggcagtgggtctgggacagacttcactctcaccatcagcagactggagcctgaagattttgcagtgtatttctgtcagcagtatggtagctcaccgctcactttcggctgcgggactaaggtggagatcaaacga

SEQ ID NO: 440 - DNA, 642 bp, Artificial Sequence; identical to SEQ ID NO: 416
  Description of Artificial Sequence: Synthetic polynucleotide

SEQ ID NO: 441 - protein, 698 aa, Artificial Sequence
  Description of Artificial Sequence: Synthetic polypeptide
QVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGPGLVKPSQTLSLTCAISGDSVSSSRTAWNWIRQSPSRCLEWLGRTYYRSKWYHDYSVSVKSRITIDPDTSKNQFSLQLNSVTPEDTAVYYCARGAAPFDYWGQGTLVTVSSGGGGSGGGGSGGGGSEIVLTQSPGTLSLSPGERATLSCRASQSVSSNYLAWYQQKPGQAPRALIYAASNRAAGISDRFSGSGSGTDFTLTISRLEPEDFAVYFCQQYGSSPLTFGCGTKVEIKR

SEQ ID NO: 442 - protein, 214 aa, Artificial Sequence; identical to SEQ ID NO: 418
  Description of Artificial Sequence: Synthetic polypeptide

SEQ ID NO: 443 - DNA, 2094 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttggtggagtctgggggaggcttagtcaagcctggagggtccctgagactctcctgtgcagcctctgaattcaccttcagtgactactacatgagctggatccgccaggctccagggaagtgcctggagtgggtttcatatattagtcgaagtggtgataccatctactacgcagactctgtgaagggccgattcaccatctccagggacaacgccaagaactcactgtatctgcaaatgaatggcctgcgagccgaagacacggccgtgtattactgtgcgagagacttagcagcaggtgctacagggggccttgactgctggggccagggaaccctggtcaccgtgtcctcaggagggggcggatctggcggcggaggaagcggtgggggcggctcctcctatgagctgactcagccaccctcagtgtccgtgtccccaggacagacagccagcatcacctgctctggagaaaggttgggaaataaatatatttgctggtatcagcagaagccaggccagtcccctgttctggtcatctatcaagatttcaagcggccctcagggatccctgagcgattctctggctccaactctgggatcacagccactctgaccatcagcgggacccaggctatggatgaggctgactattactgtcaggcgtgggacagcagaactgtggtattcggctgcgggaccaagctgaccgtcctaggt

SEQ ID NO: 444 - DNA, 642 bp, Artificial Sequence; identical to SEQ ID NO: 416
  Description of Artificial Sequence: Synthetic polynucleotide

SEQ ID NO: 445 - protein, 698 aa, Artificial Sequence
  Description of Artificial Sequence: Synthetic polypeptide
QVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASEFTFSDYYMSWIRQAPGKCLEWVSYISRSGDTIYYADSVKGRFTISRDNAKNSLYLQMNGLRAEDTAVYYCARDLAAGATGGLDCWGQGTLVTVSSGGGGSGGGGSGGGGSSYELTQPPSVSVSPGQTASITCSGERLGNKYICWYQQKPGQSPVLVIYQDFKRPSGIPERFSGSNSGITATLTISGTQAMDEADYYCQAWDSRTVVFGCGTKLTVLG

SEQ ID NO: 446 - protein, 214 aa, Artificial Sequence; identical to SEQ ID NO: 418
  Description of Artificial Sequence: Synthetic polypeptide

SEQ ID NO: 447 - DNA, 2109 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtgcagtctgggactgaggtgaagaagcctggggcctcagtgaaggtgtcctgcaaggcttctggatacaccttccccggctactatatgcactgggtgcgacaggcccctggacagtgccttgagtggatgggatggatcaaccctgacagtggtggcacaaagtatacacagaagtttcagggcagggtcaccttgaccagggacgcgtccgtcagcacagcctacattgacctgaacaggctgagatctgacgacacggccgtatattactgtgcgagagagaggtgtaggactaccaactgctatttggactactggggccagggaagtctggtcaccgtgtcctcaggagggggcggatctggcggcggaggaagcggtgggggcggctcccagtctgccctgactcagcctgcctccgtgtctgggagccctggacagtcgatcaccatctcctgcactggaaccagcagtgatgttgggaattataaccttgtctcctggtaccaacagcacccaggcaaagcccccaaactcatgatttatgaggtcaataggcggccctcaggggtttctaatcgcttctctggctccaagtctggcaacacggcctccctgacaatctctgggctccaggctgaggacgaggctgaatattactgctgctcatatgcaggtagagacactttcgtggtgttcggctgcgggaccaagctgaccgtcctaggt

SEQ ID NO: 448 - DNA, 642 bp, Artificial Sequence; identical to SEQ ID NO: 416
  Description of Artificial Sequence: Synthetic polynucleotide

SEQ ID NO: 449 - protein, 703 aa, Artificial Sequence
  Description of Artificial Sequence: Synthetic polypeptide
QVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGTEVKKPGASVKVSCKASGYTFPGYYMHWVRQAPGQCLEWMGWINPDSGGTKYTQKFQGRVTLTRDASVSTAYIDLNRLRSDDTAVYYCARERCRTTNCYLDYWGQGSLVTVSSGGGGSGGGGSGGGGSQSALTQPASVSGSPGQSITISCTGTSSDVGNYNLVSWYQQHPGKAPKLMIYEVNRRPSGVSNRFSGSKSGNTASLTISGLQAEDEAEYYCCSYAGRDTFVVFGCGTKLTVLG

SEQ ID NO: 450 - protein, 214 aa, Artificial Sequence; identical to SEQ ID NO: 418
  Description of Artificial Sequence: Synthetic polypeptide

SEQ ID NO: 451 - DNA, 642 bp, Artificial Sequence
  Description of Artificial Sequence: Synthetic polynucleotide
gacatccagatgacccagtctccatcctccctgtctgcatctgtaggagacattctcaccatcacttgccgggcaagtcagaacattaccacctatttaaattggtatcagcagaaaccagggaaagcccctaacctcctgatctctgctgcatcccgtttgcgaagtggggtcccatcaaggttcagtggcagtggatctgggacagatttcactctcaccatcagcagtctgcaacctgtagattttacaactttctactgtcaacagactttcactaccccgtggacgttcggccaagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 452 - DNA, 648 bp, Artificial Sequence
  Description of Artificial Sequence: Synthetic polynucleotide
cagtcagtgttgacgcagccgccctcagtgtctggggccccagggcagagggtcaccatctcctgcactgggagcagctccaacatcggggcaggttatgatgttcactggtaccagcaggttccaggaacagcccccaaactcctcatctatggtaacagcaagcggccctcaggggtccctgaccgattctctggctccaagtctggcacctcagcctccctggccatcactgggctccaggctgaggatgaggctgattattactgccagtcctatgacagcagcctgggtggttgggtgttcggcggagggaccaagctgaccgtcctacagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccaagagctatctgagcctgacgcctgagcagtggaagtcccacagaagctacagctgccaggtcacgcatgaagggagcaccgtggagaagacagtggcccctacagaatgttca

SEQ ID NO: 453 - DNA, 2043 bp, Artificial Sequence
  Description of Artificial Sequence: Synthetic polynucleotide
caggtgcagctggtgcagtctggggctgaggtgaagaagcctggggcctcagtgaaggtgtcctgcaaggcttctggatacaccttcgccggctactatatgcactgggtgcgacaggcccctggacaagggcttgagtggatgggatggatcaaccctgacagtggaggcacaaactttgcacagcagtttcagggcagggtcaccatgaccagggatacgtccatcagcacagcctacatggaggtgagcaggctgagatctgacgacacggccgtgttttactgtgcgagagagaagatcactatgactggtatttactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggaaaccctgtccctcacctgcactgtctctggtggctccatcagcagtagtagttactactggggctggatcaggcagcccccagggaaggggctggagtggattgggagtatctattatagtgggatcaccaactacaacccgtccctcaagagtcgagtcaccatctccgtagacacgtccaagaaccagttctccctgaagctgagttctgtgaccgccgcagacacggccgtgtattactgtgcgagatccagtaactacgatgcttttgatatctggggccaagggacaatggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 454 - protein, 214 aa, Artificial Sequence
  Description of Artificial Sequence: Synthetic polypeptide
DIQMTQSPSSLSASVGDILTITCRASQNITTYLNWYQQKPGKAPNLLISAASRLRSGVPSRFSGSGSGTDFTLTISSLQPVDFTTFYCQQTFTTPWTFGQGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 455 - protein, 216 aa, Artificial Sequence
  Description of Artificial Sequence: Synthetic polypeptide
QSVLTQPPSVSGAPGQRVTISCTGSSSNIGAGYDVHWYQQVPGTAPKLLIYGNSKRPSGVPDRFSGSKSGTSASLAITGLQAEDEADYYCQSYDSSLGGWVFGGGTKLTVLQPKAAPSVTLFPPSSEELQANKATLVCLISDFYPGAVTVAWKADSSPVKAGVETTTPSKQSNNKYAAKSYLSLTPEQWKSHRSYSCQVTHEGSTVEKTVAPTECS

SEQ ID NO: 456 - protein, 681 aa, Artificial Sequence
  Description of Artificial Sequence: Synthetic polypeptide
QVQLVQSGAEVKKPGASVKVSCKASGYTFAGYYMHWVRQAPGQGLEWMGWINPDSGGTNFAQQFQGRVTMTRDTSISTAYMEVSRLRSDDTAVFYCAREKITMTGIYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARSSNYDAFDIWGQGTMVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 457 - DNA, 642 bp, Artificial Sequence; identical to SEQ ID NO: 451
  Description of Artificial Sequence: Synthetic polynucleotide

SEQ ID NO: 458 - DNA, 642 bp, Artificial Sequence
  Description of Artificial Sequence: Synthetic polynucleotide
gacattcagatgacccagtctccatcttccgtgtctgcatctgtaggggacagagtcaccatcacttgtcgggcgagtcagggtattaccaggtggttagcctggtatcagcagaaaccagggaaagcccctaagctcctgatctatgctgcatccgttttgcaaagtggggtcccatcaaggttcagcggcagtggatctgggacagatttcactctcaccatcagcagcctgcagcctgaagattttgcaacttactattgtcaacagtctaacagtttccctcggacgttcggccaagggaccaaggtggaaatcaaacggacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 459 - DNA, 2037 bp, Artificial Sequence
  Description of Artificial Sequence: Synthetic polynucleotide
caggtgcagctggtgcagtctggggctgaggtgaagaagcctggggcctcagtgaaggtgtcctgcaaggcttctggatacaccttcgccggctactatatgcactgggtgcgacaggcccctggacaagggcttgagtggatgggatggatcaaccctgacagtggaggcacaaactttgcacagcagtttcagggcagggtcaccatgaccagggatacgtccatcagcacagcctacatggaggtgagcaggctgagatctgacgacacggccgtgttttactgtgcgagagagaagatcactatgactggtatttactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 460 - protein, 214 aa, Artificial Sequence; identical to SEQ ID NO: 454
  Description of Artificial Sequence: Synthetic polypeptide

SEQ ID NO: 461 - protein, 214 aa, Artificial Sequence
  Description of Artificial Sequence: Synthetic polypeptide
DIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGQGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 462 - protein, 679 aa, Artificial Sequence
  Description of Artificial Sequence: Synthetic polypeptide
QVQLVQSGAEVKKPGASVKVSCKASGYTFAGYYMHWVRQAPGQGLEWMGWINPDSGGTNFAQQFQGRVTMTRDTSISTAYMEVSRLRSDDTAVFYCAREKITMTGIYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 463 - DNA, 642 bp, Artificial Sequence; identical to SEQ ID NO: 451
  Description of Artificial Sequence: Synthetic polynucleotide

SEQ ID NO: 464 - DNA, 642 bp, Artificial Sequence
  Description of Artificial Sequence: Synthetic polynucleotide
gacatccagatgacccagtctccatcttccgtgtctgcttctgtcggagacagagtcaccatcacttgtcgggcgagtcaggatattagcaggtggttagcctggtatcagcagaaaccagggaaagcccctaagctcctgatttctgctgcatccagattgcaaagtggagtcccatcaaggttcagcggcagtggatctgggacagatttcactctcaccatcagcagcctgcagcctgaagattttgcaatttactattgtcaacaggctaaaagttttcctcggacgttcggccaagggaccaaggtggaaatcaaacggacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 465 - DNA, 2037 bp, Artificial Sequence
  Description of Artificial Sequence: Synthetic polynucleotide
caggtgcagctggtgcagtctggggctgaggtgaagaagcctggggcctcagtgaaggtgtcctgcaaggcttctggatacaccttcgccggctactatatgcactgggtgcgacaggcccctggacaagggcttgagtggatgggatggatcaaccctgacagtggaggcacaaactttgcacagcagtttcagggcagggtcaccatgaccagggatacgtccatcagcacagcctacatggaggtgagcaggctgagatctgacgacacggccgtgttttactgtgcgagagagaagatcactatgactggtatttactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 466 - protein, 214 aa, Artificial Sequence; identical to SEQ ID NO: 454
  Description of Artificial Sequence: Synthetic polypeptide

SEQ ID NO: 467 - protein, 214 aa, Artificial Sequence
  Description of Artificial Sequence: Synthetic polypeptide
DIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 468 - protein, 679 aa, Artificial Sequence
  Description of Artificial Sequence: Synthetic polypeptide
QVQLVQSGAEVKKPGASVKVSCKASGYTFAGYYMHWVRQAPGQGLEWMGWINPDSGGTNFAQQFQGRVTMTRDTSISTAYMEVSRLRSDDTAVFYCAREKITMTGIYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 469 - DNA, 642 bp, Artificial Sequence; identical to SEQ ID NO: 451
  Description of Artificial Sequence: Synthetic polynucleotide

SEQ ID NO: 470 - DNA, 660 bp, Artificial Sequence
  Description of Artificial Sequence: Synthetic polynucleotide
gacattgtgatgactcagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgagaatccggggtccctgaccgattcagtggcagcgggtctgggacagatttcactctcaccatcagcagcctgcaggctgaagatgtggcagtttattactgtcagcaatattatagtactcctccgacgttcggccaagggaccaaggtggagatcaaacggacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 471 - DNA, 2040 bp, Artificial Sequence
  Description of Artificial Sequence: Synthetic polynucleotide
caggtgcagctggtgcagtctggggctgaggtgaagaagcctggggcctcagtgaaggtgtcctgcaaggcttctggatacaccttcgccggctactatatgcactgggtgcgacaggcccctggacaagggcttgagtggatgggatggatcaaccctgacagtggaggcacaaactttgcacagcagtttcagggcagggtcaccatgaccagggatacgtccatcagcacagcctacatggaggtgagcaggctgagatctgacgacacggccgtgttttactgtgcgagagagaagatcactatgactggtatttactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtcgagtctggaggaggcttgatccagcctggggggtccctgagactctcctgtgcagtctctgggttcaccgtcagtagcaagttcatgacctgggtccgccaggctccagggaaggggctggagtgggtgtcagttatttatagcggtggtaagacatactacgcagactccgtgaagggccgattcaccatctccagagacaattccaagaacacgctgtatcttcaaatgaacagcctgagagccgaggacacggccgtgtattactgtgcgagagatagcggtggctgggggtactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 472 - protein, 214 aa, Artificial Sequence; identical to SEQ ID NO: 454
  Description of Artificial Sequence: Synthetic polypeptide

SEQ ID NO: 473 - protein, 220 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 474 - protein, 680 aa, Artificial Sequence
  Description of Artificial Sequence: Synthetic polypeptide
QVQLVQSGAEVKKPGASVKVSCKASGYTFAGYYMHWVRQAPGQGLEWMGWINPDSGGTNFAQQFQGRVTMTRDTSISTAYMEVSRLRSDDTAVFYCAREKITMTGIYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 475 - DNA, 642 bp, Artificial Sequence
  Description of Artificial Sequence: Synthetic polynucleotide
gacatccagatgacccagtctccatcctcactgtctgcatctgtaggagacagagtcaccatcacctgtcgggcgagtcaggacattagcaataatttagcctggtttcagcagaaaccagggaaaccccctaagtccctgatgtatgctgcatccagtttgcacagtggagtcccatcaacgttcagcggcagtggatctgggacagatttcactttcaccatcagcagcctgcagcctgaagattttgcaacttattactgccaacagtataatagttaccctctcactttcggcggagggaccaaggtggagatcagacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 476 - DNA, 648 bp, Artificial Sequence; identical to SEQ ID NO: 452
  Description of Artificial Sequence: Synthetic polynucleotide

SEQ ID NO: 477 - DNA, 2055 bp, Artificial Sequence
  Description of Artificial Sequence: Synthetic polynucleotide
caggtgcaactggtgcagtctggggctgaggtgacgaagcctggggcctcagtgaaggtgtcctgcaaggcttctggatacaccttcgccggctactatatgcactgggtgcgacaggcccctggacaagggcttgagtggatgggatggatcaaccctcacagtggtggcacaaactatgcacagaagtttcaggacagggtcaccatgaccagggacacgtccatcaacacagcctacatggaactgagcaggctgagatctgacgacacggccgtgtattactgtgcgagagaacgtatttctatggttcggggagtcgggcacaactggttcgccccctggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggaaaccctgtccctcacctgcactgtctctggtggctccatcagcagtagtagttactactggggctggatcaggcagcccccagggaaggggctggagtggattgggagtatctattatagtgggatcaccaactacaacccgtccctcaagagtcgagtcaccatctccgtagacacgtccaagaaccagttctccctgaagctgagttctgtgaccgccgcagacacggccgtgtattactgtgcgagatccagtaactacgatgcttttgatatctggggccaagggacaatggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 478 - protein, 214 aa, Artificial Sequence
  Description of Artificial Sequence: Synthetic polypeptide
DIQMTQSPSSLSASVGDRVTITCRASQDISNNLAWFQQKPGKPPKSLMYAASSLHSGVPSTFSGSGSGTDFTFTISSLQPEDFATYYCQQYNSYPLTFGGGTKVEIRRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 479 - protein, 216 aa, Artificial Sequence; identical to SEQ ID NO: 455
  Description of Artificial Sequence: Synthetic polypeptide

SEQ ID NO: 480 - protein, 685 aa, Artificial Sequence
  Description of Artificial Sequence: Synthetic polypeptide
QVQLVQSGAEVTKPGASVKVSCKASGYTFAGYYMHWVRQAPGQGLEWMGWINPHSGGTNYAQKFQDRVTMTRDTSINTAYMELSRLRSDDTAVYYCARERISMVRGVGHNWFAPWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARSSNYDAFDIWGQGTMVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 481 - DNA, 642 bp, Artificial Sequence; identical to SEQ ID NO: 475
  Description of Artificial Sequence: Synthetic polynucleotide

SEQ ID NO: 482 - DNA, 642 bp, Artificial Sequence; identical to SEQ ID NO: 458
  Description of Artificial Sequence: Synthetic polynucleotide

SEQ ID NO: 483 - DNA, 2049 bp, Artificial Sequence
  Description of Artificial Sequence: Synthetic polynucleotide
caggtgcaactggtgcagtctggggctgaggtgacgaagcctggggcctcagtgaaggtgtcctgcaaggcttctggatacaccttcgccggctactatatgcactgggtgcgacaggcccctggacaagggcttgagtggatgggatggatcaaccctcacagtggtggcacaaactatgcacagaagtttcaggacagggtcaccatgaccagggacacgtccatcaacacagcctacatggaactgagcaggctgagatctgacgacacggccgtgtattactgtgcgagagaacgtatttctatggttcggggagtcgggcacaactggttcgccccctggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 484 - protein, 214 aa, Artificial Sequence; identical to SEQ ID NO: 478
  Description of Artificial Sequence: Synthetic polypeptide

SEQ ID NO: 485 - protein, 214 aa, Artificial Sequence; identical to SEQ ID NO: 461
  Description of Artificial Sequence: Synthetic polypeptide

SEQ ID NO: 486 - protein, 683 aa, Artificial Sequence
  Description of Artificial Sequence: Synthetic polypeptide
QVQLVQSGAEVTKPGASVKVSCKASGYTFAGYYMHWVRQAPGQGLEWMGWINPHSGGTNYAQKFQDRVTMTRDTSINTAYMELSRLRSDDTAVYYCARERISMVRGVGHNWFAPWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 487 - DNA, 642 bp, Artificial Sequence; identical to SEQ ID NO: 475
  Description of Artificial Sequence: Synthetic polynucleotide

SEQ ID NO: 488 - DNA, 642 bp, Artificial Sequence; identical to SEQ ID NO: 464
  Description of Artificial Sequence: Synthetic polynucleotide

SEQ ID NO: 489 - DNA, 2049 bp, Artificial Sequence
  Description of Artificial Sequence: Synthetic polynucleotide
caggtgcaactggtgcagtctggggctgaggtgacgaagcctggggcctcagtgaaggtgtcctgcaaggcttctggatacaccttcgccggctactatatgcactgggtgcgacaggcccctggacaagggcttgagtggatgggatggatcaaccctcacagtggtggcacaaactatgcacagaagtttcaggacagggtcaccatgaccagggacacgtccatcaacacagcctacatggaactgagcaggctgagatctgacgacacggccgtgtattactgtgcgagagaacgtatttctatggttcggggagtcgggcacaactggttcgccccctggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 490 - protein, 214 aa, Artificial Sequence; identical to SEQ ID NO: 478
  Description of Artificial Sequence: Synthetic polypeptide

SEQ ID NO: 491 - protein, 214 aa, Artificial Sequence; identical to SEQ ID NO: 467
  Description of Artificial Sequence: Synthetic polypeptide

SEQ ID NO: 492 - protein, 683 aa, Artificial Sequence
  Description of Artificial Sequence: Synthetic polypeptide
QVQLVQSGAEVTKPGASVKVSCKASGYTFAGYYMHWVRQAPGQGLEWMGWINPHSGGTNYAQKFQDRVTMTRDTSINTAYMELSRLRSDDTAVYYCARERISMVRGVGHNWFAPWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 493 - DNA, 642 bp, Artificial Sequence; identical to SEQ ID NO: 475
  Description of Artificial Sequence: Synthetic polynucleotide

SEQ ID NO: 494 - DNA, 660 bp, Artificial Sequence; identical to SEQ ID NO: 470
  Description of Artificial Sequence: Synthetic polynucleotide

SEQ ID NO: 495 - DNA, 2052 bp, Artificial Sequence
  Description of Artificial Sequence: Synthetic polynucleotide
caggtgcaactggtgcagtctggggctgaggtgacgaagcctggggcctcagtgaaggtgtcctgcaaggcttctggatacaccttcgccggctactatatgcactgggtgcgacaggcccctggacaagggcttgagtggatgggatggatcaaccctcacagtggtggcacaaactatgcacagaagtttcaggacagggtcaccatgaccagggacacgtccatcaacacagcctacatggaactgagcaggctgagatctgacgacacggccgtgtattactgtgcgagagaacgtatttctatggttcggggagtcgggcacaactggttcgccccctggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtcgagtctggaggaggcttgatccagcctggggggtccctgagactctcctgtgcagtctctgggttcaccgtcagtagcaagttcatgacctgggtccgccaggctccagggaaggggctggagtgggtgtcagttatttatagcggtggtaagacatactacgcagactccgtgaagggccgattcaccatctccagagacaattccaagaacacgctgtatcttcaaatgaacagcctgagagccgaggacacggccgtgtattactgtgcgagagatagcggtggctgggggtactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 496 - protein, 214 aa, Artificial Sequence; identical to SEQ ID NO: 478
  Description of Artificial Sequence: Synthetic polypeptide

SEQ ID NO: 497 - protein, 220 aa, Artificial Sequence; identical to SEQ ID NO: 473
  Description of Artificial Sequence: Synthetic polypeptide

SEQ ID NO: 498 - protein, 684 aa, Artificial Sequence
  Description of Artificial Sequence: Synthetic polypeptide
QVQLVQSGAEVTKPGASVKVSCKASGYTFAGYYMHWVRQAPGQGLEWMGWINPHSGGTNYAQKFQDRVTMTRDTSINTAYMELSRLRSDDTAVYYCARERISMVRGVGHNWFAPWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 499 - DNA, 651 bp, Artificial Sequence
  Description of Artificial Sequence: Synthetic polynucleotide
cagtctgccctgactcagcctgcctccgtgtctgggagccctggacagtcgatcaccatctcctgcactggaaccagcagtgatgttgggaattataaccttgtctcctggtaccaacagcacccaggcaaagcccccaaactcatgatttttgaggtcaatcagcggccctcaggggtttctaatcgcttctctggctccaagtctggcaccacggcctccctgacaatctctgggctccaggctgcggacgaggctgattatttctgctgctcatatacaactagtagcacttatgtgatcttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccgaaagctatctgagcctgacgcctgagcagtggaagtcccacagaagctacagctgccaggtcacgcatgaagggagcaccgtggagaagacagtggcccctacagaatgttca

SEQ ID NO: 500 - DNA, 648 bp, Artificial Sequence; identical to SEQ ID NO: 452
  Description of Artificial Sequence: Synthetic polynucleotide

SEQ ID NO: 501 - DNA, 2040 bp, Artificial Sequence
  Description of Artificial Sequence: Synthetic polynucleotide
gaggtgcagctgctggagtctgggggaggcttggtacagcctggggggtccctgagactctcctgtgcagcctctggattcacctttagtagaaatgccatgagttgggtccgccaggctccagggaaggggctggagtgggtgtcagctactggtggtagtggtattagcacatactacgcagactccgtgaagggccggttcaccatctccagagacaattccaagaacacgctgtatctgcaaatgaacagtctgagagccgaggacacggccgtatattactgtgcgagaggttatagcaacagctggtggtactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggaaaccctgtccctcacctgcactgtctctggtggctccatcagcagtagtagttactactggggctggatcaggcagcccccagggaaggggctggagtggattgggagtatctattatagtgggatcaccaactacaacccgtccctcaagagtcgagtcaccatctccgtagacacgtccaagaaccagttctccctgaagctgagttctgtgaccgccgcagacacggccgtgtattactgtgcgagatccagtaactacgatgcttttgatatctggggccaagggacaatggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 502 - protein, 217 aa, Artificial Sequence
  Description of Artificial Sequence: Synthetic polypeptide
QSALTQPASVSGSPGQSITISCTGTSSDVGNYNLVSWYQQHPGKAPKLMIFEVNQRPSGVSNRFSGSKSGTTASLTISGLQAADEADYFCCSYTTSSTYVIFGGGTKLTVLGQPKAAPSVTLFPPSSEELQANKATLVCLISDFYPGAVTVAWKADSSPVKAGVETTTPSKQSNNKYAAESYLSLTPEQWKSHRSYSCQVTHEGSTVEKTVAPTECS

SEQ ID NO: 503 - protein, 216 aa, Artificial Sequence; identical to SEQ ID NO: 455
  Description of Artificial Sequence: Synthetic polypeptide

SEQ ID NO: 504 - protein, 680 aa, Artificial Sequence
  Description of Artificial Sequence: Synthetic polypeptide
EVQLLESGGGLVQPGGSLRLSCAASGFTFSRNAMSWVRQAPGKGLEWVSATGGSGISTYYADSVKGRFTISRDNSKNTLYLQMNSLRAEDTAVYYCARGYSNSWWYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARSSNYDAFDIWGQGTMVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 505 - DNA, 651 bp, Artificial Sequence; identical to SEQ ID NO: 499
  Description of Artificial Sequence: Synthetic polynucleotide

SEQ ID NO: 506 - DNA, 642 bp, Artificial Sequence; identical to SEQ ID NO: 458
  Description of Artificial Sequence: Synthetic polynucleotide

SEQ ID NO: 507 - DNA, 2034 bp, Artificial Sequence
  Description of Artificial Sequence: Synthetic polynucleotide
gaggtgcagctgctggagtctgggggaggcttggtacagcctggggggtccctgagactctcctgtgcagcctctggattcacctttagtagaaatgccatgagttgggtccgccaggctccagggaaggggctggagtgggtgtcagctactggtggtagtggtattagcacatactacgcagactccgtgaagggccggttcaccatctccagagacaattccaagaacacgctgtatctgcaaatgaacagtctgagagccgaggacacggccgtatattactgtgcgagaggttatagcaacagctggtggtactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 508 - protein, 217 aa, Artificial Sequence; identical to SEQ ID NO: 502
  Description of Artificial Sequence: Synthetic polypeptide

SEQ ID NO: 509 - protein, 214 aa, Artificial Sequence; identical to SEQ ID NO: 461
  Description of Artificial Sequence: Synthetic polypeptide

SEQ ID NO: 510 - protein, 678 aa, Artificial Sequence
  Description of Artificial Sequence: Synthetic polypeptide
EVQLLESGGGLVQPGGSLRLSCAASGFTFSRNAMSWVRQAPGKGLEWVSATGGSGISTYYADSVKGRFTISRDNSKNTLYLQMNSLRAEDTAVYYCARGYSNSWWYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 511 - DNA, 651 bp, Artificial Sequence; identical to SEQ ID NO: 499
  Description of Artificial Sequence: Synthetic polynucleotide

SEQ ID NO: 512 - DNA, 642 bp, Artificial Sequence; identical to SEQ ID NO: 464
  Description of Artificial Sequence: Synthetic polynucleotide

SEQ ID NO: 513 - DNA, 2034 bp, Artificial Sequence
  Description of Artificial Sequence: Synthetic polynucleotide
gaggtgcagctgctggagtctgggggaggcttggtacagcctggggggtccctgagactctcctgtgcagcctctggattcacctttagtagaaatgccatgagttgggtccgccaggctccagggaaggggctggagtgggtgtcagctactggtggtagtggtattagcacatactacgcagactccgtgaagggccggttcaccatctccagagacaattccaagaacacgctgtatctgcaaatgaacagtctgagagccgaggacacggccgtatattactgtgcgagaggttatagcaacagctggtggtactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 514 - protein, 217 aa, Artificial Sequence; identical to SEQ ID NO: 502
  Description of Artificial Sequence: Synthetic polypeptide

SEQ ID NO: 515 - protein, 214 aa, Artificial Sequence; identical to SEQ ID NO: 467
  Description of Artificial Sequence: Synthetic polypeptide

SEQ ID NO: 516 - protein, 678 aa, Artificial Sequence
  Description of Artificial Sequence: Synthetic polypeptide
EVQLLESGGGLVQPGGSLRLSCAASGFTFSRNAMSWVRQAPGKGLEWVSATGGSGISTYYADSVKGRFTISRDNSKNTLYLQMNSLRAEDTAVYYCARGYSNSWWYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 517 - DNA, 651 bp, Artificial Sequence; identical to SEQ ID NO: 499
  Description of Artificial Sequence: Synthetic polynucleotide

SEQ ID NO: 518 - DNA, 660 bp, Artificial Sequence; identical to SEQ ID NO: 470
  Description of Artificial Sequence: Synthetic polynucleotide

SEQ ID NO: 519 - DNA, 2037 bp, Artificial Sequence
  Description of Artificial Sequence: Synthetic polynucleotide
gaggtgcagctgctggagtctgggggaggcttggtacagcctggggggtccctgagactctcctgtgcagcctctggattcacctttagtagaaatgccatgagttgggtccgccaggctccagggaaggggctggagtgggtgtcagctactggtggtagtggtattagcacatactacgcagactccgtgaagggccggttcaccatctccagagacaattccaagaacacgctgtatctgcaaatgaacagtctgagagccgaggacacggccgtatattactgtgcgagaggttatagcaacagctggtggtactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtcgagtctggaggaggcttgatccagcctggggggtccctgagactctcctgtgcagtctctgggttcaccgtcagtagcaagttcatgacctgggtccgccaggctccagggaaggggctggagtgggtgtcagttatttatagcggtggtaagacatactacgcagactccgtgaagggccgattcaccatctccagagacaattccaagaacacgctgtatcttcaaatgaacagcctgagagccgaggacacggccgtgtattactgtgcgagagatagcggtggctgggggtactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 520 - protein, 217 aa, Artificial Sequence; identical to SEQ ID NO: 502
  Description of Artificial Sequence: Synthetic polypeptide

SEQ ID NO: 521 - protein, 220 aa, Artificial Sequence; identical to SEQ ID NO: 473
  Description of Artificial Sequence: Synthetic polypeptide

SEQ ID NO: 522 - protein, 679 aa, Artificial Sequence
  Description of Artificial Sequence: Synthetic polypeptide
EVQLLESGGGLVQPGGSLRLSCAASGFTFSRNAMSWVRQAPGKGLEWVSATGGSGISTYYADSVKGRFTISRDNSKNTLYLQMNSLRAEDTAVYYCARGYSNSWWYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 523 - DNA, 642 bp, Artificial Sequence
  Description of Artificial Sequence: Synthetic polynucleotide
gacatccagatgacccagtctccatcctccctgtctgcatctgtaggagacagagtcaccatcacttgccgggcaggtcagaacattagcaggcatttaaattggtatcagcagaatccagggaaagcccctaaggtcctgatccatcctgcatccagtttgccaagtggggtcccgtcaaggttcagtggcagtggatctgggacagatttcagtcttaccatcagcagtctgcaacctgaagattttggaacttacttctgtcaacagagttacagtacccctcccactttcggcggagggaccaaggtggagctcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 524 - DNA, 648 bp, Artificial Sequence; identical to SEQ ID NO: 452
  Description of Artificial Sequence: Synthetic polynucleotide

SEQ ID NO: 525 - DNA, 2055 bp, Artificial Sequence
  Description of Artificial Sequence: Synthetic polynucleotide
caggtgcaactggtgcagtctggggctgaagtgaagaagcctggggcctcagtgaaggtgtcctgcaaggcttctggatacaccttccccggctactatatgtactggttgcgacaggcccctggacaaggacttgagtggatgggatggatcaaccctgacagtggtgacacaaactatgcacagaagtttcagggcagggtcaccatgaccagggacacgtccatcagcacagcctttatggagctgagcaggctgagatcagacgacacggccgtgtattactgtgcgagagagaagcccagatattttgactccttctactactaccttatggacgtctggggccaagggaccacggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggaaaccctgtccctcacctgcactgtctctggtggctccatcagcagtagtagttactactggggctggatcaggcagcccccagggaaggggctggagtggattgggagtatctattatagtgggatcaccaactacaacccgtccctcaagagtcgagtcaccatctccgtagacacgtccaagaaccagttctccctgaagctgagttctgtgaccgccgcagacacggccgtgtattactgtgcgagatccagtaactacgatgcttttgatatctggggccaagggacaatggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 526 - protein, 214 aa, Artificial Sequence
  Description of Artificial Sequence: Synthetic polypeptide
DIQMTQSPSSLSASVGDRVTITCRAGQNISRHLNWYQQNPGKAPKVLIHPASSLPSGVPSRFSGSGSGTDFSLTISSLQPEDFGTYFCQQSYSTPPTFGGGTKVELKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 527 - protein, 216 aa, Artificial Sequence; identical to SEQ ID NO: 455
  Description of Artificial Sequence: Synthetic polypeptide

SEQ ID NO: 528 - protein, 685 aa, Artificial Sequence
  Description of Artificial Sequence: Synthetic polypeptide
QVQLVQSGAEVKKPGASVKVSCKASGYTFPGYYMYWLRQAPGQGLEWMGWINPDSGDTNYAQKFQGRVTMTRDTSISTAFMELSRLRSDDTAVYYCAREKPRYFDSFYYYLMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARSSNYDAFDIWGQGTMVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 529 - DNA, 642 bp, Artificial Sequence; identical to SEQ ID NO: 523
  Description of Artificial Sequence: Synthetic polynucleotide

SEQ ID NO: 530 - DNA, 642 bp, Artificial Sequence; identical to SEQ ID NO: 458
  Description of Artificial Sequence: Synthetic polynucleotide

SEQ ID NO: 531 - DNA, 2049 bp, Artificial Sequence
  Description of Artificial Sequence: Synthetic polynucleotide
caggtgcaactggtgcagtctggggctgaagtgaagaagcctggggcctcagtgaaggtgtcctgcaaggcttctggatacaccttccccggctactatatgtactggttgcgacaggcccctggacaaggacttgagtggatgggatggatcaaccctgacagtggtgacacaaactatgcacagaagtttcagggcagggtcaccatgaccagggacacgtccatcagcacagcctttatggagctgagcaggctgagatcagacgacacggccgtgtattactgtgcgagagagaagcccagatattttgactccttctactactaccttatggacgtctggggccaagggaccacggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 532 - protein, 214 aa, Artificial Sequence; identical to SEQ ID NO: 526
  Description of Artificial Sequence: Synthetic polypeptide

SEQ ID NO: 533 - protein, 214 aa, Artificial Sequence; identical to SEQ ID NO: 461
  Description of Artificial Sequence: Synthetic polypeptide

SEQ ID NO: 534 - protein, 683 aa, Artificial Sequence
  Description of Artificial Sequence: Synthetic polypeptide
QVQLVQSGAEVKKPGASVKVSCKASGYTFPGYYMYWLRQAPGQGLEWMGWINPDSGDTNYAQKFQGRVTMTRDTSISTAFMELSRLRSDDTAVYYCAREKPRYFDSFYYYLMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 535 - DNA, 642 bp, Artificial Sequence; identical to SEQ ID NO: 523
  Description of Artificial Sequence: Synthetic polynucleotide

SEQ ID NO: 536 - DNA, 642 bp, Artificial Sequence; identical to SEQ ID NO: 464
  Description of Artificial Sequence: Synthetic polynucleotide

SEQ ID NO: 537 - DNA, 2049 bp, Artificial Sequence
  Description of Artificial Sequence: Synthetic polynucleotide
caggtgcaactggtgcagtctggggctgaagtgaagaagcctggggcctcagtgaaggtgtcctgcaaggcttctggatacaccttccccggctactatatgtactggttgcgacaggcccctggacaaggacttgagtggatgggatggatcaaccctgacagtggtgacacaaactatgcacagaagtttcagggcagggtcaccatgaccagggacacgtccatcagcacagcctttatggagctgagcaggctgagatcagacgacacggccgtgtattactgtgcgagagagaagcccagatattttgactccttctactactaccttatggacgtctggggccaagggaccacggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 538 - protein, 214 aa, Artificial Sequence; identical to SEQ ID NO: 526
  Description of Artificial Sequence: Synthetic polypeptide

SEQ ID NO: 539 - protein, 214 aa, Artificial Sequence; identical to SEQ ID NO: 467
  Description of Artificial Sequence: Synthetic polypeptide

SEQ ID NO: 540 - protein, 683 aa, Artificial Sequence
  Description of Artificial Sequence: Synthetic polypeptide
QVQLVQSGAEVKKPGASVKVSCKASGYTFPGYYMYWLRQAPGQGLEWMGWINPDSGDTNYAQKFQGRVTMTRDTSISTAFMELSRLRSDDTAVYYCAREKPRYFDSFYYYLMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 541 - DNA, 642 bp, Artificial Sequence; identical to SEQ ID NO: 523
  Description of Artificial Sequence: Synthetic polynucleotide

SEQ ID NO: 542 - DNA, 660 bp, Artificial Sequence; identical to SEQ ID NO: 470
  Description of Artificial Sequence: Synthetic polynucleotide

SEQ ID NO: 543 - DNA, 2052 bp, Artificial Sequence
  Description of Artificial Sequence: Synthetic polynucleotide
caggtgcaactggtgcagtctggggctgaagtgaagaagcctggggcctcagtgaaggtgtcctgcaaggcttctggatacaccttccccggctactatatgtactggttgcgacaggcccctggacaaggacttgagtggatgggatggatcaaccctgacagtggtgacacaaactatgcacagaagtttcagggcagggtcaccatgaccagggacacgtccatcagcacagcctttatggagctgagcaggctgagatcagacgacacggccgtgtattactgtgcgagagagaagcccagatattttgactccttctactactaccttatggacgtctggggccaagggaccacggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtcgagtctggaggaggcttgatccagcctggggggtccctgagactctcctgtgcagtctctgggttcaccgtcagtagcaagttcatgacctgggtccgccaggctccagggaaggggctggagtgggtgtcagttatttatagcggtggtaagacatactacgcagactccgtgaagggccgattcaccatctccagagacaattccaagaacacgctgtatcttcaaatgaacagcctgagagccgaggacacggccgtgtattactgtgcgagagatagcggtggctgggggtactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 544 - protein, 214 aa, Artificial Sequence; identical to SEQ ID NO: 526
  Description of Artificial Sequence: Synthetic polypeptide

SEQ ID NO: 545 - protein, 220 aa, Artificial Sequence; identical to SEQ ID NO: 473
  Description of Artificial Sequence: Synthetic polypeptide

SEQ ID NO: 546 - protein, 684 aa, Artificial Sequence
  Description of Artificial Sequence: Synthetic polypeptide
QVQLVQSGAEVKKPGASVKVSCKASGYTFPGYYMYWLRQAPGQGLEWMGWINPDSGDTNYAQKFQGRVTMTRDTSISTAFMELSRLRSDDTAVYYCAREKPRYFDSFYYYLMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 547 - DNA, 663 bp, Artificial Sequence
  Description of Artificial Sequence: Synthetic polynucleotide
caggctgtgccgactcagccctcttccctctctgcatctcctggagcatcagccagtctcacctgcaccttacgcagtggcatcaatgttggttcctccaggatctattggtaccagcagaagccagggagtcctccccagtttctcctgaggtacacatcagactcagataaattgcagggctctggagtccccagccgcttctctggatccaaagatgcttcggccaatgcaggacttttactcatctctgggctccagtctgaggatgaggctgactattactgtatgatttggcacagcagcgctgtggtattcggcggagggaccaaactgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccgaaagctatctgagcctgacgcctgagcagtggaagtcccacagaagctacagctgccaggtcacgcatgaagggagcaccgtggagaagacagtggcccctacagaatgttca

SEQ ID NO: 548 - DNA, 648 bp, Artificial Sequence; identical to SEQ ID NO: 452
  Description of Artificial Sequence: Synthetic polynucleotide

SEQ ID NO: 549 - DNA, 2055 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagccatggcatgcactgggtccgccaacctccaggcaaggggctggagtgggtggcagttatctggtatgatggaagtaatgaatactatggagactccgtgaagggccgattcaccatctccagagacaattccaagaacacgctgtatctgcaaatgaacagcctgagagtcgaggacacggctgtgtattactgtacgagaggggggggccactggaactacgagggccactactatggtatggacgtctggggccaagggaccacggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggaaaccctgtccctcacctgcactgtctctggtggctccatcagcagtagtagttactactggggctggatcaggcagcccccagggaaggggctggagtggattgggagtatctattatagtgggatcaccaactacaacccgtccctcaagagtcgagtcaccatctccgtagacacgtccaagaaccagttctccctgaagctgagttctgtgaccgccgcagacacggccgtgtattactgtgcgagatccagtaactacgatgcttttgatatctggggccaagggacaatggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 550 - protein, 221 aa, Artificial Sequence
  Description of Artificial Sequence: Synthetic polypeptide
QAVPTQPSSLSASPGASASLTCTLRSGINVGSSRIYWYQQKPGSPPQFLLRYTSDSDKLQGSGVPSRFSGSKDASANAGLLLISGLQSEDEADYYCMIWHSSAVVFGGGTKLTVLGQPKAAPSVTLFPPSSEELQANKATLVCLISDFYPGAVTVAWKADSSPVKAGVETTTPSKQSNNKYAAESYLSLTPEQWKSHRSYSCQVTHEGSTVEKTVAPTECS

SEQ ID NO: 551 - protein, 216 aa, Artificial Sequence; identical to SEQ ID NO: 455
  Description of Artificial Sequence: Synthetic polypeptide

SEQ ID NO: 552 - protein, 685 aa, Artificial Sequence
  Description of Artificial Sequence: Synthetic polypeptide
QVQLVESGGGVVQPGRSLRLSCAASGFTFSSHGMHWVRQPPGKGLEWVAVIWYDGSNEYYGDSVKGRFTISRDNSKNTLYLQMNSLRVEDTAVYYCTRGGGHWNYEGHYYGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARSSNYDAFDIWGQGTMVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 553 - DNA, 663 bp, Artificial Sequence; identical to SEQ ID NO: 547
  Description of Artificial Sequence: Synthetic polynucleotide

SEQ ID NO: 554 - DNA, 642 bp, Artificial Sequence; identical to SEQ ID NO: 458
  Description of Artificial Sequence: Synthetic polynucleotide

SEQ ID NO: 555 - DNA, 2049 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagccatggcatgcactgggtccgccaacctccaggcaaggggctggagtgggtggcagttatctggtatgatggaagtaatgaatactatggagactccgtgaagggccgattcaccatctccagagacaattccaagaacacgctgtatctgcaaatgaacagcctgagagtcgaggacacggctgtgtattactgtacgagaggggggggccactggaactacgagggccactactatggtatggacgtctggggccaagggaccacggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 556 - protein, 221 aa, Artificial Sequence; identical to SEQ ID NO: 550
  Description of Artificial Sequence: Synthetic polypeptide

SEQ ID NO: 557 - protein, 214 aa, Artificial Sequence; identical to SEQ ID NO: 461
  Description of Artificial Sequence: Synthetic polypeptide

SEQ ID NO: 558 - protein, 683 aa, Artificial Sequence
  Description of Artificial Sequence: Synthetic polypeptide
QVQLVESGGGVVQPGRSLRLSCAASGFTFSSHGMHWVRQPPGKGLEWVAVIWYDGSNEYYGDSVKGRFTISRDNSKNTLYLQMNSLRVEDTAVYYCTRGGGHWNYEGHYYGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 559 - DNA, 663 bp, Artificial Sequence; identical to SEQ ID NO: 547
  Description of Artificial Sequence: Synthetic polynucleotide

SEQ ID NO: 560 - DNA, 642 bp, Artificial Sequence; identical to SEQ ID NO: 464
  Description of Artificial Sequence: Synthetic polynucleotide

SEQ ID NO: 561 - DNA, 2049 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagccatggcatgcactgggtccgccaacctccaggcaaggggctggagtgggtggcagttatctggtatgatggaagtaatgaatactatggagactccgtgaagggccgattcaccatctccagagacaattccaagaacacgctgtatctgcaaatgaacagcctgagagtcgaggacacggctgtgtattactgtacgagaggggggggccactggaactacgagggccactactatggtatggacgtctggggccaagggaccacggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 562 - protein, 221 aa, Artificial Sequence; identical to SEQ ID NO: 550
  Description of Artificial Sequence: Synthetic polypeptide

SEQ ID NO: 563 - protein, 214 aa, Artificial Sequence; identical to SEQ ID NO: 467
  Description of Artificial Sequence: Synthetic polypeptide

SEQ ID NO: 564 - protein, 683 aa, Artificial Sequence
  Description of Artificial Sequence: Synthetic polypeptide
QVQLVESGGGVVQPGRSLRLSCAASGFTFSSHGMHWVRQPPGKGLEWVAVIWYDGSNEYYGDSVKGRFTISRDNSKNTLYLQMNSLRVEDTAVYYCTRGGGHWNYEGHYYGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 565 - DNA, 663 bp, Artificial Sequence; identical to SEQ ID NO: 547
  Description of Artificial Sequence: Synthetic polynucleotide

SEQ ID NO: 566 - DNA, 660 bp, Artificial Sequence; identical to SEQ ID NO: 470
  Description of Artificial Sequence: Synthetic polynucleotide

SEQ ID NO: 567 - DNA, 2052 bp, Artificial Sequence
  Description of Artificial Sequence: Synthetic polynucleotide
caggtgcagttggtggagtctgggggaggcgtggtccagcctgggaggtccctgagactctcctgtgcagcgtctggattcaccttcagtagccatggcatgcactgggtccgccaacctccaggcaaggggctggagtgggtggcagttatctggtatgatggaagtaatgaatactatggagactccgtgaagggccgattcaccatctccagagacaattccaagaacacgctgtatctgcaaatgaacagcctgagagtcgaggacacggctgtgtattactgtacgagaggggggggccactggaactacgagggccactactatggtatggacgtctggggccaagggaccacggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtcgagtctggaggaggcttgatccagcctggggggtccctgagactctcctgtgcagtctctgggttcaccgtcagtagcaagttcatgacctgggtccgccaggctccagggaaggggctggagtgggtgtcagttatttatagcggtggtaagacatactacgcagactccgtgaagggccgattcaccatctccagagacaattccaagaacacgctgtatcttcaaatgaacagcctgagagccgaggacacggccgtgtattactgtgcgagagatagcggtggctgggggtactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 568 - protein, 221 aa, Artificial Sequence; identical to SEQ ID NO: 550
  Description of Artificial Sequence: Synthetic polypeptide

SEQ ID NO: 569 - protein, 220 aa, Artificial Sequence; identical to SEQ ID NO: 473
  Description of Artificial Sequence: Synthetic polypeptide

SEQ ID NO: 570 - protein, 684 aa, Artificial Sequence
  Description of Artificial Sequence: Synthetic polypeptide
QVQLVESGGGVVQPGRSLRLSCAASGFTFSSHGMHWVRQPPGKGLEWVAVIWYDGSNEYYGDSVKGRFTISRDNSKNTLYLQMNSLRVEDTAVYYCTRGGGHWNYEGHYYGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 571 - DNA, 648 bp, Artificial Sequence
  Description of Artificial Sequence: Synthetic polynucleotide
cagtctgccctgactcagcctcgctcagtgtccgggagccctggacagtcagtcaccatctcctgcactggaaccagcagtgatgttggtggttatatctttgtctcctggtaccaacaacacccaggcaaagcccccaaactcatgatttatgatgtcagtaagcggccctctggggtccctgatcgcttctctggctccaagtctgtcaacacggcctccctgaccatctctgggctccaggctgaggatgagactgattattactgctgctcatatgcaggcaactacacttatgtcttcggaactgggaccaaggtcaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccgaaagctatctgagcctgacgcctgagcagtggaagtcccacagaagctacagctgccaggtcacgcatgaagggagcaccgtggagaagacagtggcccctacagaatgttca

SEQ ID NO: 572 - DNA, 648 bp, Artificial Sequence; identical to SEQ ID NO: 452
  Description of Artificial Sequence: Synthetic polynucleotide

SEQ ID NO: 573 - DNA, 2037 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccctcagtagctatggcatgcactgggtccgccaggctccaggcaaggggctggagtgggtggcagttatctggtatgatggaagtaataaatactatgcagactccgtgaagggccgagtcaccatctccagagacaattccaagaacacgctgtatctgcaaatgaatagcctgagagccgaggacacggctgtgtattactgtacgagagatggccggaactacgtctactttgacaactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggaaaccctgtccctcacctgcactgtctctggtggctccatcagcagtagtagttactactggggctggatcaggcagcccccagggaaggggctggagtggattgggagtatctattatagtgggatcaccaactacaacccgtccctcaagagtcgagtcaccatctccgtagacacgtccaagaaccagttctccctgaagctgagttctgtgaccgccgcagacacggccgtgtattactgtgcgagatccagtaactacgatgcttttgatatctggggccaagggacaatggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 574 - protein, 216 aa, Artificial Sequence
  Description of Artificial Sequence: Synthetic polypeptide
QSALTQPRSVSGSPGQSVTISCTGTSSDVGGYIFVSWYQQHPGKAPKLMIYDVSKRPSGVPDRFSGSKSVNTASLTISGLQAEDETDYYCCSYAGNYTYVFGTGTKVTVLGQPKAAPSVTLFPPSSEELQANKATLVCLISDFYPGAVTVAWKADSSPVKAGVETTTPSKQSNNKYAAESYLSLTPEQWKSHRSYSCQVTHEGSTVEKTVAPTECS

SEQ ID NO: 575 - protein, 216 aa, Artificial Sequence; identical to SEQ ID NO: 455
  Description of Artificial Sequence: Synthetic polypeptide

SEQ ID NO: 576 - protein, 679 aa, Artificial Sequence
  Description of Artificial Sequence: Synthetic polypeptide
QVQLVESGGGVVQPGRSLRLSCAASGFTLSSYGMHWVRQAPGKGLEWVAVIWYDGSNKYYADSVKGRVTISRDNSKNTLYLQMNSLRAEDTAVYYCTRDGRNYVYFDNWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARSSNYDAFDIWGQGTMVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 577 - DNA, 648 bp, Artificial Sequence; identical to SEQ ID NO: 571
  Description of Artificial Sequence: Synthetic polynucleotide

SEQ ID NO: 578 - DNA, 642 bp, Artificial Sequence; identical to SEQ ID NO: 458
  Description of Artificial Sequence: Synthetic polynucleotide

SEQ ID NO: 579 - DNA, 2031 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccctcagtagctatggcatgcactgggtccgccaggctccaggcaaggggctggagtgggtggcagttatctggtatgatggaagtaataaatactatgcagactccgtgaagggccgagtcaccatctccagagacaattccaagaacacgctgtatctgcaaatgaatagcctgagagccgaggacacggctgtgtattactgtacgagagatggccggaactacgtctactttgacaactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 580 - protein, 216 aa, Artificial Sequence; identical to SEQ ID NO: 574
  Description of Artificial Sequence: Synthetic polypeptide

SEQ ID NO: 581 - protein, 214 aa, Artificial Sequence; identical to SEQ ID NO: 461
  Description of Artificial Sequence: Synthetic polypeptide

SEQ ID NO: 582 - protein, 677 aa, Artificial Sequence
  Description of Artificial Sequence: Synthetic polypeptide
QVQLVESGGGVVQPGRSLRLSCAASGFTLSSYGMHWVRQAPGKGLEWVAVIWYDGSNKYYADSVKGRVTISRDNSKNTLYLQMNSLRAEDTAVYYCTRDGRNYVYFDNWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 583 - DNA, 648 bp, Artificial Sequence; identical to SEQ ID NO: 571
  Description of Artificial Sequence: Synthetic polynucleotide

SEQ ID NO: 584 - DNA, 642 bp, Artificial Sequence; identical to SEQ ID NO: 464
  Description of Artificial Sequence: Synthetic polynucleotide

SEQ ID NO: 585 - DNA, 2031 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccctcagtagctatggcatgcactgggtccgccaggctccaggcaaggggctggagtgggtggcagttatctggtatgatggaagtaataaatactatgcagactccgtgaagggccgagtcaccatctccagagacaattccaagaacacgctgtatctgcaaatgaatagcctgagagccgaggacacggctgtgtattactgtacgagagatggccggaactacgtctactttgacaactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 586 - protein, 216 aa, Artificial Sequence; identical to SEQ ID NO: 574
  Description of Artificial Sequence: Synthetic polypeptide

SEQ ID NO: 587 - protein, 214 aa, Artificial Sequence; identical to SEQ ID NO: 467
  Description of Artificial Sequence: Synthetic polypeptide

SEQ ID NO: 588 - protein, 677 aa, Artificial Sequence
  Description of Artificial Sequence: Synthetic polypeptide
QVQLVESGGGVVQPGRSLRLSCAASGFTLSSYGMHWVRQAPGKGLEWVAVIWYDGSNKYYADSVKGRVTISRDNSKNTLYLQMNSLRAEDTAVYYCTRDGRNYVYFDNWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 589 - DNA, 648 bp, Artificial Sequence; identical to SEQ ID NO: 571
  Description of Artificial Sequence: Synthetic polynucleotide

SEQ ID NO: 590 - DNA, 660 bp, Artificial Sequence; identical to SEQ ID NO: 470
  Description of Artificial Sequence: Synthetic polynucleotide

SEQ ID NO: 591 - DNA, 2034 bp, Artificial Sequence
  Description of Artificial Sequence: Synthetic polynucleotide
caggtgcagctggtggagtctgggggaggcgtggtccagcctgggaggtccctgagactctcctgtgcagcgtctggattcaccctcagtagctatggcatgcactgggtccgccaggctccaggcaaggggctggagtgggtggcagttatctggtatgatggaagtaataaatactatgcagactccgtgaagggccgagtcaccatctccagagacaattccaagaacacgctgtatctgcaaatgaatagcctgagagccgaggacacggctgtgtattactgtacgagagatggccggaactacgtctactttgacaactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtcgagtctggaggaggcttgatccagcctggggggtccctgagactctcctgtgcagtctctgggttcaccgtcagtagcaagttcatgacctgggtccgccaggctccagggaaggggctggagtgggtgtcagttatttatagcggtggtaagacatactacgcagactccgtgaagggccgattcaccatctccagagacaattccaagaacacgctgtatcttcaaatgaacagcctgagagccgaggacacggccgtgtattactgtgcgagagatagcggtggctgggggtactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 592 - protein, 216 aa, Artificial Sequence; identical to SEQ ID NO: 574
  Description of Artificial Sequence: Synthetic polypeptide

SEQ ID NO: 593 - protein, 220 aa, Artificial Sequence; identical to SEQ ID NO: 473
  Description of Artificial Sequence: Synthetic polypeptide

SEQ ID NO: 594 - protein, 678 aa, Artificial Sequence
  Description of Artificial Sequence: Synthetic polypeptide
QVQLVESGGGVVQPGRSLRLSCAASGFTLSSYGMHWVRQAPGKGLEWVAVIWYDGSNKYYADSVKGRVTISRDNSKNTLYLQMNSLRAEDTAVYYCTRDGRNYVYFDNWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 595 - DNA, 645 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagcaactacttagcctggtaccaacagaaacctggccaggctcccagggcccttatctatgctgcatccaacagggccgctggcatctcagacaggttcagtggcagtgggtctgggacagacttcactctcaccatcagcagactggagcctgaagattttgcagtgtatttctgtcagcagtatggtagctcaccgctcactttcggcggagggactaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 596 - DNA, 648 bp, Artificial Sequence; identical to SEQ ID NO: 452
  Description of Artificial Sequence: Synthetic polynucleotide

SEQ ID NO: 597 - DNA, 2037 bp, Artificial Sequence
  Description of Artificial Sequence: Synthetic polynucleotide
caggtacagctgcaacagtcaggtccaggactggtgaagccctcgcagaccctctcactcacctgtgccatctccggggacagtgtctctagcagccgtactgcttggaactggatcaggcagtccccatcgagaggccttgagtggctgggaaggacatactacaggtccaagtggtatcatgattattcagtatctgtgaaaagtcgaatcaccatcgacccagacacatccaagaaccagttctccctgcagctgaactctgtgactcccgaggacacggctgtttattattgtgcaagaggggctgctccctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggaaaccctgtccctcacctgcactgtctctggtggctccatcagcagtagtagttactactggggctggatcaggcagcccccagggaaggggctggagtggattgggagtatctattatagtgggatcaccaactacaacccgtccctcaagagtcgagtcaccatctccgtagacacgtccaagaaccagttctccctgaagctgagttctgtgaccgccgcagacacggccgtgtattactgtgcgagatccagtaactacgatgcttttgatatctggggccaagggacaatggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 598 - protein, 215 aa, Artificial Sequence
  Description of Artificial Sequence: Synthetic polypeptide
EIVLTQSPGTLSLSPGERATLSCRASQSVSSNYLAWYQQKPGQAPRALIYAASNRAAGISDRFSGSGSGTDFTLTISRLEPEDFAVYFCQQYGSSPLTFGGGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 599 - protein, 216 aa, Artificial Sequence; identical to SEQ ID NO: 455
  Description of Artificial Sequence: Synthetic polypeptide

SEQ ID NO: 600 - protein, 679 aa, Artificial Sequence
  Description of Artificial Sequence: Synthetic polypeptide
QVQLQQSGPGLVKPSQTLSLTCAISGDSVSSSRTAWNWIRQSPSRGLEWLGRTYYRSKWYHDYSVSVKSRITIDPDTSKNQFSLQLNSVTPEDTAVYYCARGAAPFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARSSNYDAFDIWGQGTMVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 601 - DNA, 645 bp, Artificial Sequence; identical to SEQ ID NO: 595
  Description of Artificial Sequence: Synthetic polynucleotide

SEQ ID NO: 602 - DNA, 642 bp, Artificial Sequence; identical to SEQ ID NO: 458
  Description of Artificial Sequence: Synthetic polynucleotide

SEQ ID NO: 603 - DNA, 2031 bp, Artificial Sequence
  Description of Artificial Sequence: Synthetic polynucleotide
caggtacagctgcaacagtcaggtccaggactggtgaagccctcgcagaccctctcactcacctgtgccatctccggggacagtgtctctagcagccgtactgcttggaactggatcaggcagtccccatcgagaggccttgagtggctgggaaggacatactacaggtccaagtggtatcatgattattcagtatctgtgaaaagtcgaatcaccatcgacccagacacatccaagaaccagttctccctgcagctgaactctgtgactcccgaggacacggctgtttattattgtgcaagaggggctgctccctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 604 - protein, 215 aa, Artificial Sequence; identical to SEQ ID NO: 598
  Description of Artificial Sequence: Synthetic polypeptide

SEQ ID NO: 605 - protein, 214 aa, Artificial Sequence; identical to SEQ ID NO: 461
  Description of Artificial Sequence: Synthetic polypeptide

SEQ ID NO: 606 - protein, 677 aa, Artificial Sequence
  Description of Artificial Sequence: Synthetic polypeptide
QVQLQQSGPGLVKPSQTLSLTCAISGDSVSSSRTAWNWIRQSPSRGLEWLGRTYYRSKWYHDYSVSVKSRITIDPDTSKNQFSLQLNSVTPEDTAVYYCARGAAPFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 607 - DNA, 645 bp, Artificial Sequence; identical to SEQ ID NO: 595
  Description of Artificial Sequence: Synthetic polynucleotide

SEQ ID NO: 608 - DNA, 642 bp, Artificial Sequence; identical to SEQ ID NO: 464
  Description of Artificial Sequence: Synthetic polynucleotide

SEQ ID NO: 609 - DNA, 2031 bp, Artificial Sequence
  Description of Artificial Sequence: Synthetic polynucleotide
caggtacagctgcaacagtcaggtccaggactggtgaagccctcgcagaccctctcactcacctgtgccatctccggggacagtgtctctagcagccgtactgcttggaactggatcaggcagtccccatcgagaggccttgagtggctgggaaggacatactacaggtccaagtggtatcatgattattcagtatctgtgaaaagtcgaatcaccatcgacccagacacatccaagaaccagttctccctgcagctgaactctgtgactcccgaggacacggctgtttattattgtgcaagaggggctgctccctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 610 - protein, 215 aa, Artificial Sequence; identical to SEQ ID NO: 598
  Description of Artificial Sequence: Synthetic polypeptide

SEQ ID NO: 611 - protein, 214 aa, Artificial Sequence; identical to SEQ ID NO: 467
  Description of Artificial Sequence: Synthetic polypeptide

SEQ ID NO: 612 - protein, 677 aa, Artificial Sequence
  Description of Artificial Sequence: Synthetic polypeptide
QVQLQQSGPGLVKPSQTLSLTCAISGDSVSSSRTAWNWIRQSPSRGLEWLGRTYYRSKWYHDYSVSVKSRITIDPDTSKNQFSLQLNSVTPEDTAVYYCARGAAPFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 613 - DNA, 645 bp, Artificial Sequence; identical to SEQ ID NO: 595
  Description of Artificial Sequence: Synthetic polynucleotide

SEQ ID NO: 614 - DNA, 660 bp, Artificial Sequence; identical to SEQ ID NO: 470
  Description of Artificial Sequence: Synthetic polynucleotide

SEQ ID NO: 615 - DNA, 2034 bp, Artificial Sequence
  Description of Artificial Sequence: Synthetic polynucleotide
caggtacagctgcaacagtcaggtccaggactggtgaagccctcgcagaccctctcactcacctgtgccatctccggggacagtgtctctagcagccgtactgcttggaactggatcaggcagtccccatcgagaggccttgagtggctgggaaggacatactacaggtccaagtggtatcatgattattcagtatctgtgaaaagtcgaatcaccatcgacccagacacatccaagaaccagttctccctgcagctgaactctgtgactcccgaggacacggctgtttattattgtgcaagaggggctgctccctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtcgagtctggaggaggcttgatccagcctggggggtccctgagactctcctgtgcagtctctgggttcaccgtcagtagcaagttcatgacctgggtccgccaggctccagggaaggggctggagtgggtgtcagttatttatagcggtggtaagacatactacgcagactccgtgaagggccgattcaccatctccagagacaattccaagaacacgctgtatcttcaaatgaacagcctgagagccgaggacacggccgtgtattactgtgcgagagatagcggtggctgggggtactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 616 - protein, 215 aa, Artificial Sequence; identical to SEQ ID NO: 598
  Description of Artificial Sequence: Synthetic polypeptide

SEQ ID NO: 617 - protein, 220 aa, Artificial Sequence; identical to SEQ ID NO: 473
  Description of Artificial Sequence: Synthetic polypeptide

SEQ ID NO: 618 - protein, 678 aa, Artificial Sequence
  Description of Artificial Sequence: Synthetic polypeptide
QVQLQQSGPGLVKPSQTLSLTCAISGDSVSSSRTAWNWIRQSPSRGLEWLGRTYYRSKWYHDYSVSVKSRITIDPDTSKNQFSLQLNSVTPEDTAVYYCARGAAPFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 619 - DNA, 636 bp, Artificial Sequence
  Description of Artificial Sequence: Synthetic polynucleotide
tcctatgagctgactcagccaccctcagtgtccgtgtccccaggacagacagccagcatcacctgctctggagaaaggttgggaaataaatatatttgctggtatcagcagaagccaggccagtcccctgttctggtcatctatcaagatttcaagcggccctcagggatccctgagcgattctctggctccaactctgggatcacagccactctgaccatcagcgggacccaggctatggatgaggctgactattactgtcaggcgtgggacagcagaactgtggtattcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccgaaagctatctgagcctgacgcctgagcagtggaagtcccacagaagctacagctgccaggtcacgcatgaagggagcaccgtggagaagacagtggcccctacagaatgttca

SEQ ID NO: 620 - DNA, 648 bp, Artificial Sequence; identical to SEQ ID NO: 452
  Description of Artificial Sequence: Synthetic polynucleotide

SEQ ID NO: 621 - DNA, 2043 bp, Artificial Sequence
  Description of Artificial Sequence: Synthetic polynucleotide
caggtgcagttggtggagtctgggggaggcttagtcaagcctggagggtccctgagactctcctgtgcagcctctgaattcaccttcagtgactactacatgagctggatccgccaggctccagggaaggggctggagtgggtttcatatattagtcgaagtggtgataccatctactacgcagactctgtgaagggccgattcaccatctccagggacaacgccaagaactcactgtatctgcaaatgaatggcctgcgagccgaagacacggccgtgtattactgtgcgagagacttagcagcaggtgctacagggggccttgactgctggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggaaaccctgtccctcacctgcactgtctctggtggctccatcagcagtagtagttactactggggctggatcaggcagcccccagggaaggggctggagtggattgggagtatctattatagtgggatcaccaactacaacccgtccctcaagagtcgagtcaccatctccgtagacacgtccaagaaccagttctccctgaagctgagttctgtgaccgccgcagacacggccgtgtattactgtgcgagatccagtaactacgatgcttttgatatctggggccaagggacaatggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 622 - protein, 212 aa, Artificial Sequence
  Description of Artificial Sequence: Synthetic polypeptide
SYELTQPPSVSVSPGQTASITCSGERLGNKYICWYQQKPGQSPVLVIYQDFKRPSGIPERFSGSNSGITATLTISGTQAMDEADYYCQAWDSRTVVFGGGTKLTVLGQPKAAPSVTLFPPSSEELQANKATLVCLISDFYPGAVTVAWKADSSPVKAGVETTTPSKQSNNKYAAESYLSLTPEQWKSHRSYSCQVTHEGSTVEKTVAPTECS

SEQ ID NO: 623 - protein, 216 aa, Artificial Sequence; identical to SEQ ID NO: 455
  Description of Artificial Sequence: Synthetic polypeptide

SEQ ID NO: 624 - protein, 681 aa, Artificial Sequence
  Description of Artificial Sequence: Synthetic polypeptide
QVQLVESGGGLVKPGGSLRLSCAASEFTFSDYYMSWIRQAPGKGLEWVSYISRSGDTIYYADSVKGRFTISRDNAKNSLYLQMNGLRAEDTAVYYCARDLAAGATGGLDCWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARSSNYDAFDIWGQGTMVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 625 - DNA, 636 bp, Artificial Sequence; identical to SEQ ID NO: 619
  Description of Artificial Sequence: Synthetic polynucleotide

SEQ ID NO: 626 - DNA, 642 bp, Artificial Sequence; identical to SEQ ID NO: 458
  Description of Artificial Sequence: Synthetic polynucleotide

SEQ ID NO: 627 - DNA, 2037 bp, Artificial Sequence
  Description of Artificial Sequence: Synthetic polynucleotide
caggtgcagttggtggagtctgggggaggcttagtcaagcctggagggtccctgagactctcctgtgcagcctctgaattcaccttcagtgactactacatgagctggatccgccaggctccagggaaggggctggagtgggtttcatatattagtcgaagtggtgataccatctactacgcagactctgtgaagggccgattcaccatctccagggacaacgccaagaactcactgtatctgcaaatgaatggcctgcgagccgaagacacggccgtgtattactgtgcgagagacttagcagcaggtgctacagggggccttgactgctggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 628 - protein, 212 aa, Artificial Sequence; identical to SEQ ID NO: 622
  Description of Artificial Sequence: Synthetic polypeptide

SEQ ID NO: 629 - protein, 214 aa, Artificial Sequence; identical to SEQ ID NO: 461
  Description of Artificial Sequence: Synthetic polypeptide

SEQ ID NO: 630 - protein, 679 aa, Artificial Sequence
  Description of Artificial Sequence: Synthetic polypeptide
QVQLVESGGGLVKPGGSLRLSCAASEFTFSDYYMSWIRQAPGKGLEWVSYISRSGDTIYYADSVKGRFTISRDNAKNSLYLQMNGLRAEDTAVYYCARDLAAGATGGLDCWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 631 - DNA, 636 bp, Artificial Sequence; identical to SEQ ID NO: 619
  Description of Artificial Sequence: Synthetic polynucleotide

SEQ ID NO: 632 - DNA, 642 bp, Artificial Sequence; identical to SEQ ID NO: 464
  Description of Artificial Sequence: Synthetic polynucleotide

SEQ ID NO: 633 - DNA, 2037 bp, Artificial Sequence
  Description of Artificial Sequence: Synthetic polynucleotide
caggtgcagttggtggagtctgggggaggcttagtcaagcctggagggtccctgagactctcctgtgcagcctctgaattcaccttcagtgactactacatgagctggatccgccaggctccagggaaggggctggagtgggtttcatatattagtcgaagtggtgataccatctactacgcagactctgtgaagggccgattcaccatctccagggacaacgccaagaactcactgtatctgcaaatgaatggcctgcgagccgaagacacggccgtgtattactgtgcgagagacttagcagcaggtgctacagggggccttgactgctggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 634 - protein, 212 aa, Artificial Sequence; identical to SEQ ID NO: 622
  Description of Artificial Sequence: Synthetic polypeptide

SEQ ID NO: 635 - protein, 214 aa, Artificial Sequence; identical to SEQ ID NO: 467
  Description of Artificial Sequence: Synthetic polypeptide

SEQ ID NO: 636 - protein, 679 aa, Artificial Sequence
  Description of Artificial Sequence: Synthetic polypeptide
QVQLVESGGGLVKPGGSLRLSCAASEFTFSDYYMSWIRQAPGKGLEWVSYISRSGDTIYYADSVKGRFTISRDNAKNSLYLQMNGLRAEDTAVYYCARDLAAGATGGLDCWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 637 - DNA, 636 bp, Artificial Sequence; identical to SEQ ID NO: 619
  Description of Artificial Sequence: Synthetic polynucleotide

SEQ ID NO: 638 - DNA, 660 bp, Artificial Sequence; identical to SEQ ID NO: 470
  Description of Artificial Sequence: Synthetic polynucleotide

SEQ ID NO: 639 - DNA, 2040 bp, Artificial Sequence
  Description of Artificial Sequence: Synthetic polynucleotide
caggtgcagttggtggagtctgggggaggcttagtcaagcctggagggtccctgagactctcctgtgcagcctctgaattcaccttcagtgactactacatgagctggatccgccaggctccagggaaggggctggagtgggtttcatatattagtcgaagtggtgataccatctactacgcagactctgtgaagggccgattcaccatctccagggacaacgccaagaactcactgtatctgcaaatgaatggcctgcgagccgaagacacggccgtgtattactgtgcgagagacttagcagcaggtgctacagggggccttgactgctggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtcgagtctggaggaggcttgatccagcctggggggtccctgagactctcctgtgcagtctctgggttcaccgtcagtagcaagttcatgacctgggtccgccaggctccagggaaggggctggagtgggtgtcagttatttatagcggtggtaagacatactacgcagactccgtgaagggccgattcaccatctccagagacaattccaagaacacgctgtatcttcaaatgaacagcctgagagccgaggacacggccgtgtattactgtgcgagagatagcggtggctgggggtactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 640 - protein, 212 aa, Artificial Sequence; identical to SEQ ID NO: 622
  Description of Artificial Sequence: Synthetic polypeptide

SEQ ID NO: 641 - protein, 220 aa, Artificial Sequence; identical to SEQ ID NO: 473
  Description of Artificial Sequence: Synthetic polypeptide

SEQ ID NO: 642 - protein, 680 aa, Artificial Sequence
  Description of Artificial Sequence: Synthetic polypeptide
QVQLVESGGGLVKPGGSLRLSCAASEFTFSDYYMSWIRQAPGKGLEWVSYISRSGDTIYYADSVKGRFTISRDNAKNSLYLQMNGLRAEDTAVYYCARDLAAGATGGLDCWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 643 - DNA, 651 bp, Artificial Sequence
  Description of Artificial Sequence: Synthetic polynucleotide
cagtctgccctgactcagcctgcctccgtgtctgggagccctggacagtcgatcaccatctcctgcactggaaccagcagtgatgttgggaattataaccttgtctcctggtaccaacagcacccaggcaaagcccccaaactcatgatttatgaggtcaataggcggccctcaggggtttctaatcgcttctctggctccaagtctggcaacacggcctccctgacaatctctgggctccaggctgaggacgaggctgaatattactgctgctcatatgcaggtagagacactttcgtggtgttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccgaaagctatctgagcctgacgcctgagcagtggaagtcccacagaagctacagctgccaggtcacgcatgaagggagcaccgtggagaagacagtggcccctacagaatgttca

SEQ ID NO: 644 - DNA, 648 bp, Artificial Sequence; identical to SEQ ID NO: 452
  Description of Artificial Sequence: Synthetic polynucleotide

SEQ ID NO: 645 - DNA, 2043 bp, Artificial Sequence
  Description of Artificial Sequence: Synthetic polynucleotide
caggtgcagctggtgcagtctgggactgaggtgaagaagcctggggcctcagtgaaggtgtcctgcaaggcttctggatacaccttccccggctactatatgcactgggtgcgacaggcccctggacaggggcttgagtggatgggatggatcaaccctgacagtggtggcacaaagtatacacagaagtttcagggcagggtcaccttgaccagggacgcgtccgtcagcacagcctacattgacctgaacaggctgagatctgacgacacggccgtatattactgtgcgagagagaggtgtaggactaccaactgctatttggactactggggccagggaagtctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggaaaccctgtccctcacctgcactgtctctggtggctccatcagcagtagtagttactactggggctggatcaggcagcccccagggaaggggctggagtggattgggagtatctattatagtgggatcaccaactacaacccgtccctcaagagtcgagtcaccatctccgtagacacgtccaagaaccagttctccctgaagctgagttctgtgaccgccgcagacacggccgtgtattactgtgcgagatccagtaactacgatgcttttgatatctggggccaagggacaatggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 646 - protein, 217 aa, Artificial Sequence
  Description of Artificial Sequence: Synthetic polypeptide
QSALTQPASVSGSPGQSITISCTGTSSDVGNYNLVSWYQQHPGKAPKLMIYEVNRRPSGVSNRFSGSKSGNTASLTISGLQAEDEAEYYCCSYAGRDTFVVFGGGTKLTVLGQPKAAPSVTLFPPSSEELQANKATLVCLISDFYPGAVTVAWKADSSPVKAGVETTTPSKQSNNKYAAESYLSLTPEQWKSHRSYSCQVTHEGSTVEKTVAPTECS

SEQ ID NO: 647 - protein, 216 aa, Artificial Sequence; identical to SEQ ID NO: 455
  Description of Artificial Sequence: Synthetic polypeptide

SEQ ID NO: 648 - protein, 681 aa, Artificial Sequence
  Description of Artificial Sequence: Synthetic polypeptide
QVQLVQSGTEVKKPGASVKVSCKASGYTFPGYYMHWVRQAPGQGLEWMGWINPDSGGTKYTQKFQGRVTLTRDASVSTAYIDLNRLRSDDTAVYYCARERCRTTNCYLDYWGQGSLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARSSNYDAFDIWGQGTMVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 649 - DNA, 651 bp, Artificial Sequence; identical to SEQ ID NO: 643
  Description of Artificial Sequence: Synthetic polynucleotide

SEQ ID NO: 650 - DNA, 642 bp, Artificial Sequence; identical to SEQ ID NO: 458
  Description of Artificial Sequence: Synthetic polynucleotide

SEQ ID NO: 651 - DNA, 2037 bp, Artificial Sequence
  Description of Artificial Sequence: Synthetic polynucleotide
caggtgcagctggtgcagtctgggactgaggtgaagaagcctggggcctcagtgaaggtgtcctgcaaggcttctggatacaccttccccggctactatatgcactgggtgcgacaggcccctggacaggggcttgagtggatgggatggatcaaccctgacagtggtggcacaaagtatacacagaagtttcagggcagggtcaccttgaccagggacgcgtccgtcagcacagcctacattgacctgaacaggctgagatctgacgacacggccgtatattactgtgcgagagagaggtgtaggactaccaactgctatttggactactggggccagggaagtctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 652 - protein, 217 aa, Artificial Sequence; identical to SEQ ID NO: 646
  Description of Artificial Sequence: Synthetic polypeptide

SEQ ID NO: 653 - protein, 214 aa, Artificial Sequence; identical to SEQ ID NO: 461
  Description of Artificial Sequence: Synthetic polypeptide

SEQ ID NO: 654 - protein, 679 aa, Artificial Sequence
  Description of Artificial Sequence: Synthetic polypeptide
QVQLVQSGTEVKKPGASVKVSCKASGYTFPGYYMHWVRQAPGQGLEWMGWINPDSGGTKYTQKFQGRVTLTRDASVSTAYIDLNRLRSDDTAVYYCARERCRTTNCYLDYWGQGSLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 655 - DNA, 651 bp, Artificial Sequence; identical to SEQ ID NO: 643
  Description of Artificial Sequence: Synthetic polynucleotide

SEQ ID NO: 656 - DNA, 642 bp, Artificial Sequence; identical to SEQ ID NO: 464
  Description of Artificial Sequence: Synthetic polynucleotide

SEQ ID NO: 657 - DNA, 2037 bp, Artificial Sequence
  Description of Artificial Sequence: Synthetic polynucleotide
caggtgcagctggtgcagtctgggactgaggtgaagaagcctggggcctcagtgaaggtgtcctgcaaggcttctggatacaccttccccggctactatatgcactgggtgcgacaggcccctggacaggggcttgagtggatgggatggatcaaccctgacagtggtggcacaaagtatacacagaagtttcagggcagggtcaccttgaccagggacgcgtccgtcagcacagcctacattgacctgaacaggctgagatctgacgacacggccgtatattactgtgcgagagagaggtgtaggactaccaactgctatttggactactggggccagggaagtctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 658 - protein, 217 aa, Artificial Sequence; identical to SEQ ID NO: 646
  Description of Artificial Sequence: Synthetic polypeptide

SEQ ID NO: 659 - protein, 214 aa, Artificial Sequence; identical to SEQ ID NO: 467
  Description of Artificial Sequence: Synthetic polypeptide

SEQ ID NO: 660 - protein, 679 aa, Artificial Sequence
  Description of Artificial Sequence: Synthetic polypeptide
QVQLVQSGTEVKKPGASVKVSCKASGYTFPGYYMHWVRQAPGQGLEWMGWINPDSGGTKYTQKFQGRVTLTRDASVSTAYIDLNRLRSDDTAVYYCARERCRTTNCYLDYWGQGSLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 661 - DNA, 651 bp, Artificial Sequence; identical to SEQ ID NO: 643
  Description of Artificial Sequence: Synthetic polynucleotide

SEQ ID NO: 662 - DNA, 660 bp, Artificial Sequence; identical to SEQ ID NO: 470
  Description of Artificial Sequence: Synthetic polynucleotide

SEQ ID NO: 663 - DNA, 2040 bp, Artificial Sequence
  Description of Artificial Sequence: Synthetic polynucleotide
caggtgcagctggtgcagtctgggactgaggtgaagaagcctggggcctcagtgaaggtgtcctgcaaggcttctggatacaccttccccggctactatatgcactgggtgcgacaggcccctggacaggggcttgagtggatgggatggatcaaccctgacagtggtggcacaaagtatacacagaagtttcagggcagggtcaccttgaccagggacgcgtccgtcagcacagcctacattgacctgaacaggctgagatctgacgacacggccgtatattactgtgcgagagagaggtgtaggactaccaactgctatttggactactggggccagggaagtctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtcgagtctggaggaggcttgatccagcctggggggtccctgagactctcctgtgcagtctctgggttcaccgtcagtagcaagttcatgacctgggtccgccaggctccagggaaggggctggagtgggtgtcagttatttatagcggtggtaagacatactacgcagactccgtgaagggccgattcaccatctccagagacaattccaagaacacgctgtatcttcaaatgaacagcctgagagccgaggacacggccgtgtattactgtgcgagagatagcggtggctgggggtactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 664 - protein, 217 aa, Artificial Sequence; identical to SEQ ID NO: 646
  Description of Artificial Sequence: Synthetic polypeptide

SEQ ID NO: 665 - protein, 220 aa, Artificial Sequence; identical to SEQ ID NO: 473
  Description of Artificial Sequence: Synthetic polypeptide

SEQ ID NO: 666 - protein, 680 aa, Artificial Sequence
  Description of Artificial Sequence: Synthetic polypeptide
QVQLVQSGTEVKKPGASVKVSCKASGYTFPGYYMHWVRQAPGQGLEWMGWINPDSGGTKYTQKFQGRVTLTRDASVSTAYIDLNRLRSDDTAVYYCARERCRTTNCYLDYWGQGSLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 667 - DNA, 648 bp, Artificial Sequence
  Description of Artificial Sequence: Synthetic polynucleotide
cagtcagtgttgacgcagccgccctcagtgtctggggccccagggcagagggtcaccatctcctgcactgggagcagctccaacatcggggcaggttatgatgttcactggtaccagcaggttccaggaacagcccccaaactcctcatctatggtaacagcaagcggccctcaggggtccctgaccgattctctggctccaagtctggcacctcagcctccctggccatcactgggctccaggctgaggatgaggctgattattactgccagtcctatgacagcagcctgggtggttgggtgttcggcggagggaccaagctgaccgtcctacagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccgaaagctatctgagcctgacgcctgagcagtggaagtcccacagaagctacagctgccaggtcacgcatgaagggagcaccgtggagaagacagtggcccctacagaatgttca

SEQ ID NO: 668 - DNA, 642 bp, Artificial Sequence
  Description of Artificial Sequence: Synthetic polynucleotide
gacatccagatgacccagtctccatcctccctgtctgcatctgtaggagacattctcaccatcacttgccgggcaagtcagaacattaccacctatttaaattggtatcagcagaaaccagggaaagcccctaacctcctgatctctgctgcatcccgtttgcgaagtggggtcccatcaaggttcagtggcagtggatctgggacagatttcactctcaccatcagcagtctgcaacctgtagattttacaactttctactgtcaacagactttcactaccccgtggacgttcggccaagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 669 - DNA, 2043 bp, Artificial Sequence
  Description of Artificial Sequence: Synthetic polynucleotide
caggtgcagctgcaggagtcgggcccaggactggtgaagccttcggaaaccctgtccctcacctgcactgtctctggtggctccatcagcagtagtagttactactggggctggatcaggcagcccccagggaaggggctggagtggattgggagtatctattatagtgggatcaccaactacaacccgtccctcaagagtcgagtcaccatctccgtagacacgtccaagaaccagttctccctgaagctgagttctgtgaccgccgcagacacggccgtgtattactgtgcgaggcccagtaactacgatgcttttgatatctggggccaagggacaatggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtgcagtctggggctgaggtgaagaagcctggggcctcagtgaaggtgtcctgcaaggcttctggatacaccttcgccggctactatatgcactgggtgcgacaggcccctggacaagggcttgagtggatgggatggatcaaccctgacagtggaggcacaaactttgcacagcagtttcagggcagggtcaccatgaccagggatacgtccatcagcacagcctacatggaggtgagcaggctgagatctgacgacacggccgtgttttactgtgcgagagagaagatcactatgactggtatttactttgactattggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 670 - protein, 216 aa, Artificial Sequence
  Description of Artificial Sequence: Synthetic polypeptide
QSVLTQPPSVSGAPGQRVTISCTGSSSNIGAGYDVHWYQQVPGTAPKLLIYGNSKRPSGVPDRFSGSKSGTSASLAITGLQAEDEADYYCQSYDSSLGGWVFGGGTKLTVLQPKAAPSVTLFPPSSEELQANKATLVCLISDFYPGAVTVAWKADSSPVKAGVETTTPSKQSNNKYAAESYLSLTPEQWKSHRSYSCQVTHEGSTVEKTVAPTECS

SEQ ID NO: 671 - protein, 214 aa, Artificial Sequence
  Description of Artificial Sequence: Synthetic polypeptide
DIQMTQSPSSLSASVGDILTITCRASQNITTYLNWYQQKPGKAPNLLISAASRLRSGVPSRFSGSGSGTDFTLTISSLQPVDFTTFYCQQTFTTPWTFGQGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 672 - protein, 681 aa, Artificial Sequence
  Description of Artificial Sequence: Synthetic polypeptide
QVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARPSNYDAFDIWGQGTMVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGAEVKKPGASVKVSCKASGYTFAGYYMHWVRQAPGQGLEWMGWINPDSGGTNFAQQFQGRVTMTRDTSISTAYMEVSRLRSDDTAVFYCAREKITMTGIYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 673 - DNA, 648 bp, Artificial Sequence; identical to SEQ ID NO: 667
  Description of Artificial Sequence: Synthetic polynucleotide

SEQ ID NO: 674 - DNA, 642 bp, Artificial Sequence
  Description of Artificial Sequence: Synthetic polynucleotide
gacatccagatgacccagtctccatcctcactgtctgcatctgtaggagacagagtcaccatcacctgtcgggcgagtcaggacattagcaataatttagcctggtttcagcagaaaccagggaaaccccctaagtccctgatgtatgctgcatccagtttgcacagtggagtcccatcaacgttcagcggcagtggatctgggacagatttcactttcaccatcagcagcctgcagcctgaagattttgcaacttattactgccaacagtataatagttaccctctcactttcggcggagggaccaaggtggagatcagacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 675 - DNA, 2055 bp, Artificial Sequence
  Description of Artificial Sequence: Synthetic polynucleotide
caggtgcagctgcaggagtcgggcccaggactggtgaagccttcggaaaccctgtccctcacctgcactgtctctggtggctccatcagcagtagtagttactactggggctggatcaggcagcccccagggaaggggctggagtggattgggagtatctattatagtgggatcaccaactacaacccgtccctcaagagtcgagtcaccatctccgtagacacgtccaagaaccagttctccctgaagctgagttctgtgaccgccgcagacacggccgtgtattactgtgcgaggcccagtaactacgatgcttttgatatctggggccaagggacaatggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcaactggtgcagtctggggctgaggtgacgaagcctggggcctcagtgaaggtgtcctgcaaggcttctggatacaccttcgccggctactatatgcactgggtgcgacaggcccctggacaagggcttgagtggatgggatggatcaaccctcacagtggtggcacaaactatgcacagaagtttcaggacagggtcaccatgaccagggacacgtccatcaacacagcctacatggaactgagcaggctgagatctgacgacacggccgtgtattactgtgcgagagaacgtatttctatggttcggggagtcgggcacaactggttcgccccctggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 676 - protein, 216 aa, Artificial Sequence; identical to SEQ ID NO: 670
  Description of Artificial Sequence: Synthetic polypeptide

SEQ ID NO: 677 - protein, 214 aa, Artificial Sequence
  Description of Artificial Sequence: Synthetic polypeptide
DIQMTQSPSSLSASVGDRVTITCRASQDISNNLAWFQQKPGKPPKSLMYAASSLHSGVPSTFSGSGSGTDFTFTISSLQPEDFATYYCQQYNSYPLTFGGGTKVEIRRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 678 - protein, 685 aa, Artificial Sequence
  Description of Artificial Sequence: Synthetic polypeptide
QVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARPSNYDAFDIWGQGTMVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGAEVTKPGASVKVSCKASGYTFAGYYMHWVRQAPGQGLEWMGWINPHSGGTNYAQKFQDRVTMTRDTSINTAYMELSRLRSDDTAVYYCARERISMVRGVGHNWFAPWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 679 - DNA, 648 bp, Artificial Sequence; identical to SEQ ID NO: 667
  Description of Artificial Sequence: Synthetic polynucleotide

SEQ ID NO: 680 - DNA, 651 bp, Artificial Sequence
  Description of Artificial Sequence: Synthetic polynucleotide
cagtctgccctgactcagcctgcctccgtgtctgggagccctggacagtcgatcaccatctcctgcactggaaccagcagtgatgttgggaattataaccttgtctcctggtaccaacagcacccaggcaaagcccccaaactcatgatttttgaggtcaatcagcggccctcaggggtttctaatcgcttctctggctccaagtctggcaccacggcctccctgacaatctctgggctccaggctgcggacgaggctgattatttctgctgctcatatacaactagtagcacttatgtgatcttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccaagagctatctgagcctgacgcctgagcagtggaagtcccacagaagctacagctgccaggtcacgcatgaagggagcaccgtggagaagacagtggcccctacagaatgttca

SEQ ID NO: 681 - DNA, 2040 bp, Artificial Sequence
  Description of Artificial Sequence: Synthetic polynucleotide
caggtgcagctgcaggagtcgggcccaggactggtgaagccttcggaaaccctgtccctcacctgcactgtctctggtggctccatcagcagtagtagttactactggggctggatcaggcagcccccagggaaggggctggagtggattgggagtatctattatagtgggatcaccaactacaacccgtccctcaagagtcgagtcaccatctccgtagacacgtccaagaaccagttctccctgaagctgagttctgtgaccgccgcagacacggccgtgtattactgtgcgaggcccagtaactacgatgcttttgatatctggggccaagggacaatggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctgctggagtctgggggaggcttggtacagcctggggggtccctgagactctcctgtgcagcctctggattcacctttagtagaaatgccatgagttgggtccgccaggctccagggaaggggctggagtgggtgtcagctactggtggtagtggtattagcacatactacgcagactccgtgaagggccggttcaccatctccagagacaattccaagaacacgctgtatctgcaaatgaacagtctgagagccgaggacacggccgtatattactgtgcgagaggttatagcaacagctggtggtactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 682 - protein, 216 aa, Artificial Sequence; identical to SEQ ID NO: 670
  Description of Artificial Sequence: Synthetic polypeptide

SEQ ID NO: 683 - protein, 217 aa, Artificial Sequence
  Description of Artificial Sequence: Synthetic polypeptide
QSALTQPASVSGSPGQSITISCTGTSSDVGNYNLVSWYQQHPGKAPKLMIFEVNQRPSGVSNRFSGSKSGTTASLTISGLQAADEADYFCCSYTTSSTYVIFGGGTKLTVLGQPKAAPSVTLFPPSSEELQANKATLVCLISDFYPGAVTVAWKADSSPVKAGVETTTPSKQSNNKYAAKSYLSLTPEQWKSHRSYSCQVTHEGSTVEKTVAPTECS

SEQ ID NO: 684 - protein, 680 aa, Artificial Sequence
  Description of Artificial Sequence: Synthetic polypeptide
QVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARPSNYDAFDIWGQGTMVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLLESGGGLVQPGGSLRLSCAASGFTFSRNAMSWVRQAPGKGLEWVSATGGSGISTYYADSVKGRFTISRDNSKNTLYLQMNSLRAEDTAVYYCARGYSNSWWYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 685 - DNA, 648 bp, Artificial Sequence; identical to SEQ ID NO: 667
  Description of Artificial Sequence: Synthetic polynucleotide

SEQ ID NO: 686 - DNA, 642 bp, Artificial Sequence
  Description of Artificial Sequence: Synthetic polynucleotide
gacatccagatgacccagtctccatcctccctgtctgcatctgtaggagacagagtcaccatcacttgccgggcaggtcagaacattagcaggcatttaaattggtatcagcagaatccagggaaagcccctaaggtcctgatccatcctgcatccagtttgccaagtggggtcccgtcaaggttcagtggcagtggatctgggacagatttcagtcttaccatcagcagtctgcaacctgaagattttggaacttacttctgtcaacagagttacagtacccctcccactttcggcggagggaccaaggtggagctcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 687 - DNA, 2055 bp, Artificial Sequence
  Description of Artificial Sequence: Synthetic polynucleotide
caggtgcagctgcaggagtcgggcccaggactggtgaagccttcggaaaccctgtccctcacctgcactgtctctggtggctccatcagcagtagtagttactactggggctggatcaggcagcccccagggaaggggctggagtggattgggagtatctattatagtgggatcaccaactacaacccgtccctcaagagtcgagtcaccatctccgtagacacgtccaagaaccagttctccctgaagctgagttctgtgaccgccgcagacacggccgtgtattactgtgcgaggcccagtaactacgatgcttttgatatctggggccaagggacaatggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcaactggtgcagtctggggctgaagtgaagaagcctggggcctcagtgaaggtgtcctgcaaggcttctggatacaccttccccggctactatatgtactggttgcgacaggcccctggacaaggacttgagtggatgggatggatcaaccctgacagtggtgacacaaactatgcacagaagtttcagggcagggtcaccatgaccagggacacgtccatcagcacagcctttatggagctgagcaggctgagatcagacgacacggccgtgtattactgtgcgagagagaagcccagatattttgactccttctactactaccttatggacgtctggggccaagggaccacggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 688 - protein, 216 aa, Artificial Sequence; identical to SEQ ID NO: 670
  Description of Artificial Sequence: Synthetic polypeptide

SEQ ID NO: 689 - protein, 214 aa, Artificial Sequence
  Description of Artificial Sequence: Synthetic polypeptide
DIQMTQSPSSLSASVGDRVTITCRAGQNISRHLNWYQQNPGKAPKVLIHPASSLPSGVPSRFSGSGSGTDFSLTISSLQPEDFGTYFCQQSYSTPPTFGGGTKVELKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 690 - protein, 685 aa, Artificial Sequence
  Description of Artificial Sequence: Synthetic polypeptide
QVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARPSNYDAFDIWGQGTMVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGAEVKKPGASVKVSCKASGYTFPGYYMYWLRQAPGQGLEWMGWINPDSGDTNYAQKFQGRVTMTRDTSISTAFMELSRLRSDDTAVYYCAREKPRYFDSFYYYLMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 691 - DNA, 648 bp, Artificial Sequence; identical to SEQ ID NO: 667
  Description of Artificial Sequence: Synthetic polynucleotide

SEQ ID NO: 692 - DNA, 663 bp, Artificial Sequence
  Description of Artificial Sequence: Synthetic polynucleotide
caggctgtgccgactcagccctcttccctctctgcatctcctggagcatcagccagtctcacctgcaccttacgcagtggcatcaatgttggttcctccaggatctattggtaccagcagaagccagggagtcctccccagtttctcctgaggtacacatcagactcagataaattgcagggctctggagtccccagccgcttctctggatccaaagatgcttcggccaatgcaggacttttactcatctctgggctccagtctgaggatgaggctgactattactgtatgatttggcacagcagcgctgtggtattcggcggagggaccaaactgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccaagagctatctgagcctgacgcctgagcagtggaagtcccacagaagctacagctgccaggtcacgcatgaagggagcaccgtggagaagacagtggcccctacagaatgttca

SEQ ID NO: 693 - DNA, 2055 bp, Artificial Sequence
  Description of Artificial Sequence: Synthetic polynucleotide
caggtgcagctgcaggagtcgggcccaggactggtgaagccttcggaaaccctgtccctcacctgcactgtctctggtggctccatcagcagtagtagttactactggggctggatcaggcagcccccagggaaggggctggagtggattgggagtatctattatagtgggatcaccaactacaacccgtccctcaagagtcgagtcaccatctccgtagacacgtccaagaaccagttctccctgaagctgagttctgtgaccgccgcagacacggccgtgtattactgtgcgaggcccagtaactacgatgcttttgatatctggggccaagggacaatggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttggtggagtctgggggaggcgtggtccagcctgggaggtccctgagactctcctgtgcagcgtctggattcaccttcagtagccatggcatgcactgggtccgccaacctccaggcaaggggctggagtgggtggcagttatctggtatgatggaagtaatgaatactatggagactccgtgaagggccgattcaccatctccagagacaattccaagaacacgctgtatctgcaaatgaacagcctgagagtcgaggacacggctgtgtattactgtacgagaggggggggccactggaactacgagggccactactatggtatggacgtctggggccaagggaccacggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 694 - protein, 216 aa, Artificial Sequence; identical to SEQ ID NO: 670
  Description of Artificial Sequence: Synthetic polypeptide

SEQ ID NO: 695 - protein, 221 aa, Artificial Sequence
  Description of Artificial Sequence: Synthetic polypeptide
QAVPTQPSSLSASPGASASLTCTLRSGINVGSSRIYWYQQKPGSPPQFLLRYTSDSDKLQGSGVPSRFSGSKDASANAGLLLISGLQSEDEADYYCMIWHSSAVVFGGGTKLTVLGQPKAAPSVTLFPPSSEELQANKATLVCLISDFYPGAVTVAWKADSSPVKAGVETTTPSKQSNNKYAAKSYLSLTPEQWKSHRSYSCQVTHEGSTVEKTVAPTECS

SEQ ID NO: 696 - protein, 685 aa, Artificial Sequence
  Description of Artificial Sequence: Synthetic polypeptide
QVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARPSNYDAFDIWGQGTMVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSHGMHWVRQPPGKGLEWVAVIWYDGSNEYYGDSVKGRFTISRDNSKNTLYLQMNSLRVEDTAVYYCTRGGGHWNYEGHYYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 697 - DNA, 648 bp, Artificial Sequence; identical to SEQ ID NO: 667
  Description of Artificial Sequence: Synthetic polynucleotide

SEQ ID NO: 698 - DNA, 648 bp, Artificial Sequence
  Description of Artificial Sequence: Synthetic polynucleotide
cagtctgccctgactcagcctcgctcagtgtccgggagccctggacagtcagtcaccatctcctgcactggaaccagcagtgatgttggtggttatatctttgtctcctggtaccaacaacacccaggcaaagcccccaaactcatgatttatgatgtcagtaagcggccctctggggtccctgatcgcttctctggctccaagtctgtcaacacggcctccctgaccatctctgggctccaggctgaggatgagactgattattactgctgctcatatgcaggcaactacacttatgtcttcggaactgggaccaaggtcaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccaagagctatctgagcctgacgcctgagcagtggaagtcccacagaagctacagctgccaggtcacgcatgaagggagcaccgtggagaagacagtggcccctacagaatgttca

SEQ ID NO: 699 - DNA, 2037 bp, Artificial Sequence
  Description of Artificial Sequence: Synthetic polynucleotide
caggtgcagctgcaggagtcgggcccaggactggtgaagccttcggaaaccctgtccctcacctgcactgtctctggtggctccatcagcagtagtagttactactggggctggatcaggcagcccccagggaaggggctggagtggattgggagtatctattatagtgggatcaccaactacaacccgtccctcaagagtcgagtcaccatctccgtagacacgtccaagaaccagttctccctgaagctgagttctgtgaccgccgcagacacggccgtgtattactgtgcgaggcccagtaactacgatgcttttgatatctggggccaagggacaatggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcgtggtccagcctgggaggtccctgagactctcctgtgcagcgtctggattcaccctcagtagctatggcatgcactgggtccgccaggctccaggcaaggggctggagtgggtggcagttatctggtatgatggaagtaataaatactatgcagactccgtgaagggccgagtcaccatctccagagacaattccaagaacacgctgtatctgcaaatgaatagcctgagagccgaggacacggctgtgtattactgtacgagagatggccggaactacgtctactttgacaactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 700 - protein, 216 aa, Artificial Sequence; identical to SEQ ID NO: 670
  Description of Artificial Sequence: Synthetic polypeptide

SEQ ID NO: 701 - protein, 216 aa, Artificial Sequence
  Description of Artificial Sequence: Synthetic polypeptide
QSALTQPRSVSGSPGQSVTISCTGTSSDVGGYIFVSWYQQHPGKAPKLMIYDVSKRPSGVPDRFSGSKSVNTASLTISGLQAEDETDYYCCSYAGNYTYVFGTGTKVTVLGQPKAAPSVTLFPPSSEELQANKATLVCLISDFYPGAVTVAWKADSSPVKAGVETTTPSKQSNNKYAAKSYLSLTPEQWKSHRSYSCQVTHEGSTVEKTVAPTECS

SEQ ID NO: 702 - protein, 679 aa, Artificial Sequence
  Description of Artificial Sequence: Synthetic polypeptide
QVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARPSNYDAFDIWGQGTMVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTLSSYGMHWVRQAPGKGLEWVAVIWYDGSNKYYADSVKGRVTISRDNSKNTLYLQMNSLRAEDTAVYYCTRDGRNYVYFDNWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 703 - DNA, 648 bp, Artificial Sequence; identical to SEQ ID NO: 667
  Description of Artificial Sequence: Synthetic polynucleotide

SEQ ID NO: 704 - DNA, 645 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttagcagcaactacttagcctggtaccaacagaaacctggccaggctcccagggcccttatctatgctgcatccaacagggccgctggcatctcagacaggttcagtggcagtgggtctgggacagacttcactctcaccatcagcagactggagcctgaagattttgcagtgtatttctgtcagcagtatggtagctcaccgctcactttcggcggagggactaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 705 - DNA, 2037 bp, Artificial Sequence
  Description of Artificial Sequence: Synthetic polynucleotide
caggtgcagctgcaggagtcgggcccaggactggtgaagccttcggaaaccctgtccctcacctgcactgtctctggtggctccatcagcagtagtagttactactggggctggatcaggcagcccccagggaaggggctggagtggattgggagtatctattatagtgggatcaccaactacaacccgtccctcaagagtcgagtcaccatctccgtagacacgtccaagaaccagttctccctgaagctgagttctgtgaccgccgcagacacggccgtgtattactgtgcgaggcccagtaactacgatgcttttgatatctggggccaagggacaatggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagctgcaacagtcaggtccaggactggtgaagccctcgcagaccctctcactcacctgtgccatctccggggacagtgtctctagcagccgtactgcttggaactggatcaggcagtccccatcgagaggccttgagtggctgggaaggacatactacaggtccaagtggtatcatgattattcagtatctgtgaaaagtcgaatcaccatcgacccagacacatccaagaaccagttctccctgcagctgaactctgtgactcccgaggacacggctgtttattattgtgcaagaggggctgctccctttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 706 - protein, 216 aa, Artificial Sequence; identical to SEQ ID NO: 670
  Description of Artificial Sequence: Synthetic polypeptide

SEQ ID NO: 707 - protein, 215 aa, Artificial Sequence
  Description of Artificial Sequence: Synthetic polypeptide
EIVLTQSPGTLSLSPGERATLSCRASQSVSSNYLAWYQQKPGQAPRALIYAASNRAAGISDRFSGSGSGTDFTLTISRLEPEDFAVYFCQQYGSSPLTFGGGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 708 - protein, 679 aa, Artificial Sequence
  Description of Artificial Sequence: Synthetic polypeptide
QVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARPSNYDAFDIWGQGTMVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGPGLVKPSQTLSLTCAISGDSVSSSRTAWNWIRQSPSRGLEWLGRTYYRSKWYHDYSVSVKSRITIDPDTSKNQFSLQLNSVTPEDTAVYYCARGAAPFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 709 - DNA, 648 bp, Artificial Sequence; identical to SEQ ID NO: 667
  Description of Artificial Sequence: Synthetic polynucleotide

SEQ ID NO: 710 - DNA, 636 bp, Artificial Sequence
  Description of Artificial Sequence: Synthetic polynucleotide
tcctatgagctgactcagccaccctcagtgtccgtgtccccaggacagacagccagcatcacctgctctggagaaaggttgggaaataaatatatttgctggtatcagcagaagccaggccagtcccctgttctggtcatctatcaagatttcaagcggccctcagggatccctgagcgattctctggctccaactctgggatcacagccactctgaccatcagcgggacccaggctatggatgaggctgactattactgtcaggcgtgggacagcagaactgtggtattcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccaagagctatctgagcctgacgcctgagcagtggaagtcccacagaagctacagctgccaggtcacgcatgaagggagcaccgtggagaagacagtggcccctacagaatgttca

SEQ ID NO: 711 - DNA, 2043 bp, Artificial Sequence
  Description of Artificial Sequence: Synthetic polynucleotide
caggtgcagctgcaggagtcgggcccaggactggtgaagccttcggaaaccctgtccctcacctgcactgtctctggtggctccatcagcagtagtagttactactggggctggatcaggcagcccccagggaaggggctggagtggattgggagtatctattatagtgggatcaccaactacaacccgtccctcaagagtcgagtcaccatctccgtagacacgtccaagaaccagttctccctgaagctgagttctgtgaccgccgcagacacggccgtgtattactgtgcgaggcccagtaactacgatgcttttgatatctggggccaagggacaatggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttggtggagtctgggggaggcttagtcaagcctggagggtccctgagactctcctgtgcagcctctgaattcaccttcagtgactactacatgagctggatccgccaggctccagggaaggggctggagtgggtttcatatattagtcgaagtggtgataccatctactacgcagactctgtgaagggccgattcaccatctccagggacaacgccaagaactcactgtatctgcaaatgaatggcctgcgagccgaagacacggccgtgtattactgtgcgagagacttagcagcaggtgctacagggggccttgactgctggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 712 - protein, 216 aa, Artificial Sequence; identical to SEQ ID NO: 670
  Description of Artificial Sequence: Synthetic polypeptide

SEQ ID NO: 713 - protein, 212 aa, Artificial Sequence
  Description of Artificial Sequence: Synthetic polypeptide
SYELTQPPSVSVSPGQTASITCSGERLGNKYICWYQQKPGQSPVLVIYQDFKRPSGIPERFSGSNSGITATLTISGTQAMDEADYYCQAWDSRTVVFGGGTKLTVLGQPKAAPSVTLFPPSSEELQANKATLVCLISDFYPGAVTVAWKADSSPVKAGVETTTPSKQSNNKYAAKSYLSLTPEQWKSHRSYSCQVTHEGSTVEKTVAPTECS

SEQ ID NO: 714 - protein, 681 aa, Artificial Sequence
  Description of Artificial Sequence: Synthetic polypeptide
QVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARPSNYDAFDIWGQGTMVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASEFTFSDYYMSWIRQAPGKGLEWVSYISRSGDTIYYADSVKGRFTISRDNAKNSLYLQMNGLRAEDTAVYYCARDLAAGATGGLDCWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 715 - DNA, 648 bp, Artificial Sequence; identical to SEQ ID NO: 667
  Description of Artificial Sequence: Synthetic polynucleotide

SEQ ID NO: 716 - DNA, 651 bp, Artificial Sequence
  Description of Artificial Sequence: Synthetic polynucleotide
cagtctgccctgactcagcctgcctccgtgtctgggagccctggacagtcgatcaccatctcctgcactggaaccagcagtgatgttgggaattataaccttgtctcctggtaccaacagcacccaggcaaagcccccaaactcatgatttatgaggtcaataggcggccctcaggggtttctaatcgcttctctggctccaagtctggcaacacggcctccctgacaatctctgggctccaggctgaggacgaggctgaatattactgctgctcatatgcaggtagagacactttcgtggtgttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccaagagctatctgagcctgacgcctgagcagtggaagtcccacagaagctacagctgccaggtcacgcatgaagggagcaccgtggagaagacagtggcccctacagaatgttca

SEQ ID NO: 717 - DNA, 2043 bp, Artificial Sequence
  Description of Artificial Sequence: Synthetic polynucleotide
caggtgcagctgcaggagtcgggcccaggactggtgaagccttcggaaaccctgtccctcacctgcactgtctctggtggctccatcagcagtagtagttactactggggctggatcaggcagcccccagggaaggggctggagtggattgggagtatctattatagtgggatcaccaactacaacccgtccctcaagagtcgagtcaccatctccgtagacacgtccaagaaccagttctccctgaagctgagttctgtgaccgccgcagacacggccgtgtattactgtgcgaggcccagtaactacgatgcttttgatatctggggccaagggacaatggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtgcagtctgggactgaggtgaagaagcctggggcctcagtgaaggtgtcctgcaaggcttctggatacaccttccccggctactatatgcactgggtgcgacaggcccctggacaggggcttgagtggatgggatggatcaaccctgacagtggtggcacaaagtatacacagaagtttcagggcagggtcaccttgaccagggacgcgtccgtcagcacagcctacattgacctgaacaggctgagatctgacgacacggccgtatattactgtgcgagagagaggtgtaggactaccaactgctatttggactactggggccagggaagtctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 718 - protein, 216 aa, Artificial Sequence; identical to SEQ ID NO: 670
  Description of Artificial Sequence: Synthetic polypeptide

SEQ ID NO: 719 - protein, 217 aa, Artificial Sequence
  Description of Artificial Sequence: Synthetic polypeptide
QSALTQPASVSGSPGQSITISCTGTSSDVGNYNLVSWYQQHPGKAPKLMIYEVNRRPSGVSNRFSGSKSGNTASLTISGLQAEDEAEYYCCSYAGRDTFVVFGGGTKLTVLGQPKAAPSVTLFPPSSEELQANKATLVCLISDFYPGAVTVAWKADSSPVKAGVETTTPSKQSNNKYAAKSYLSLTPEQWKSHRSYSCQVTHEGSTVEKTVAPTECS

SEQ ID NO: 720 - protein, 681 aa, Artificial Sequence
  Description of Artificial Sequence: Synthetic polypeptide
QVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARPSNYDAFDIWGQGTMVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGTEVKKPGASVKVSCKASGYTFPGYYMHWVRQAPGQGLEWMGWINPDSGGTKYTQKFQGRVTLTRDASVSTAYIDLNRLRSDDTAVYYCARERCRTTNCYLDYWGQGSLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 721 - DNA, 642 bp, Artificial Sequence
  Description of Artificial Sequence: Synthetic polynucleotide
gacattcagatgacccagtctccatcttccgtgtctgcatctgtaggggacagagtcaccatcacttgtcgggcgagtcagggtattaccaggtggttagcctggtatcagcagaaaccagggaaagcccctaagctcctgatctatgctgcatccgttttgcaaagtggggtcccatcaaggttcagcggcagtggatctgggacagatttcactctcaccatcagcagcctgcagcctgaagattttgcaacttactattgtcaacagtctaacagtttccctcggacgttcggccaagggaccaaggtggaaatcaaacggacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 722 - DNA, 642 bp, Artificial Sequence; identical to SEQ ID NO: 668
  Description of Artificial Sequence: Synthetic polynucleotide

SEQ ID NO: 723 - DNA, 2037 bp, Artificial Sequence
  Description of Artificial Sequence: Synthetic polynucleotide
caggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtgcagtctggggctgaggtgaagaagcctggggcctcagtgaaggtgtcctgcaaggcttctggatacaccttcgccggctactatatgcactgggtgcgacaggcccctggacaagggcttgagtggatgggatggatcaaccctgacagtggaggcacaaactttgcacagcagtttcagggcagggtcaccatgaccagggatacgtccatcagcacagcctacatggaggtgagcaggctgagatctgacgacacggccgtgttttactgtgcgagagagaagatcactatgactggtatttactttgactattggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 724 - protein, 214 aa, Artificial Sequence
  Description of Artificial Sequence: Synthetic polypeptide
DIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGQGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 725 - protein, 214 aa, Artificial Sequence; identical to SEQ ID NO: 671
  Description of Artificial Sequence: Synthetic polypeptide

SEQ ID NO: 726 - protein, 679 aa, Artificial Sequence
  Description of Artificial Sequence: Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGAEVKKPGASVKVSCKASGYTFAGYYMHWVRQAPGQGLEWMGWINPDSGGTNFAQQFQGRVTMTRDTSISTAYMEVSRLRSDDTAVFYCAREKITMTGIYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 727 - DNA, 642 bp, Artificial Sequence; identical to SEQ ID NO: 721
  Description of Artificial Sequence: Synthetic polynucleotide

SEQ ID NO: 728 - DNA, 642 bp, Artificial Sequence; identical to SEQ ID NO: 674
  Description of Artificial Sequence: Synthetic polynucleotide

SEQ ID NO: 729 - DNA, 2049 bp, Artificial Sequence
  Description of Artificial Sequence: Synthetic polynucleotide
caggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcaactggtgcagtctggggctgaggtgacgaagcctggggcctcagtgaaggtgtcctgcaaggcttctggatacaccttcgccggctactatatgcactgggtgcgacaggcccctggacaagggcttgagtggatgggatggatcaaccctcacagtggtggcacaaactatgcacagaagtttcaggacagggtcaccatgaccagggacacgtccatcaacacagcctacatggaactgagcaggctgagatctgacgacacggccgtgtattactgtgcgagagaacgtatttctatggttcggggagtcgggcacaactggttcgccccctggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 730 - protein, 214 aa, Artificial Sequence; identical to SEQ ID NO: 724
  Description of Artificial Sequence: Synthetic polypeptide

SEQ ID NO: 731 - protein, 214 aa, Artificial Sequence; identical to SEQ ID NO: 677
  Description of Artificial Sequence: Synthetic polypeptide

SEQ ID NO: 732 - protein, 683 aa, Artificial Sequence
  Description of Artificial Sequence: Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGAEVTKPGASVKVSCKASGYTFAGYYMHWVRQAPGQGLEWMGWINPHSGGTNYAQKFQDRVTMTRDTSINTAYMELSRLRSDDTAVYYCARERISMVRGVGHNWFAPWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 733 - DNA, 642 bp, Artificial Sequence; identical to SEQ ID NO: 721
  Description of Artificial Sequence: Synthetic polynucleotide

SEQ ID NO: 734 - DNA, 651 bp, Artificial Sequence; identical to SEQ ID NO: 680
  Description of Artificial Sequence: Synthetic polynucleotide

SEQ ID NO: 735 - DNA, 2034 bp, Artificial Sequence
  Description of Artificial Sequence: Synthetic polynucleotide
caggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctgctggagtctgggggaggcttggtacagcctggggggtccctgagactctcctgtgcagcctctggattcacctttagtagaaatgccatgagttgggtccgccaggctccagggaaggggctggagtgggtgtcagctactggtggtagtggtattagcacatactacgcagactccgtgaagggccggttcaccatctccagagacaattccaagaacacgctgtatctgcaaatgaacagtctgagagccgaggacacggccgtatattactgtgcgagaggttatagcaacagctggtggtactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 736 - protein, 214 aa, Artificial Sequence; identical to SEQ ID NO: 724
  Description of Artificial Sequence: Synthetic polypeptide

SEQ ID NO: 737 - protein, 217 aa, Artificial Sequence; identical to SEQ ID NO: 683
  Description of Artificial Sequence: Synthetic polypeptide

SEQ ID NO: 738 - protein, 678 aa, Artificial Sequence
  Description of Artificial Sequence: Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLLESGGGLVQPGGSLRLSCAASGFTFSRNAMSWVRQAPGKGLEWVSATGGSGISTYYADSVKGRFTISRDNSKNTLYLQMNSLRAEDTAVYYCARGYSNSWWYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 739 - DNA, 642 bp, Artificial Sequence; identical to SEQ ID NO: 721
  Description of Artificial Sequence: Synthetic polynucleotide

SEQ ID NO: 740 - DNA, 642 bp, Artificial Sequence; identical to SEQ ID NO: 686
  Description of Artificial Sequence: Synthetic polynucleotide

SEQ ID NO: 741 - DNA, 2049 bp, Artificial Sequence
  Description of Artificial Sequence: Synthetic polynucleotide
caggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcaactggtgcagtctggggctgaagtgaagaagcctggggcctcagtgaaggtgtcctgcaaggcttctggatacaccttccccggctactatatgtactggttgcgacaggcccctggacaaggacttgagtggatgggatggatcaaccctgacagtggtgacacaaactatgcacagaagtttcagggcagggtcaccatgaccagggacacgtccatcagcacagcctttatggagctgagcaggctgagatcagacgacacggccgtgtattactgtgcgagagagaagcccagatattttgactccttctactactaccttatggacgtctggggccaagggaccacggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 742 - protein, 214 aa, Artificial Sequence; identical to SEQ ID NO: 724
  Description of Artificial Sequence: Synthetic polypeptide

SEQ ID NO: 743 - protein, 214 aa, Artificial Sequence; identical to SEQ ID NO: 689
  Description of Artificial Sequence: Synthetic polypeptide

SEQ ID NO: 744 - protein, 683 aa, Artificial Sequence
  Description of Artificial Sequence: Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGAEVKKPGASVKVSCKASGYTFPGYYMYWLRQAPGQGLEWMGWINPDSGDTNYAQKFQGRVTMTRDTSISTAFMELSRLRSDDTAVYYCAREKPRYFDSFYYYLMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 745 - DNA, 642 bp, Artificial Sequence; identical to SEQ ID NO: 721
  Description of Artificial Sequence: Synthetic polynucleotide

SEQ ID NO: 746 - DNA, 663 bp, Artificial Sequence; identical to SEQ ID NO: 692
  Description of Artificial Sequence: Synthetic polynucleotide

SEQ ID NO: 747 - DNA, 2049 bp, Artificial Sequence
  Description of Artificial Sequence: Synthetic polynucleotide
caggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttggtggagtctgggggaggcgtggtccagcctgggaggtccctgagactctcctgtgcagcgtctggattcaccttcagtagccatggcatgcactgggtccgccaacctccaggcaaggggctggagtgggtggcagttatctggtatgatggaagtaatgaatactatggagactccgtgaagggccgattcaccatctccagagacaattccaagaacacgctgtatctgcaaatgaacagcctgagagtcgaggacacggctgtgtattactgtacgagaggggggggccactggaactacgagggccactactatggtatggacgtctggggccaagggaccacggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 748 - protein, 214 aa, Artificial Sequence; identical to SEQ ID NO: 724
  Description of Artificial Sequence: Synthetic polypeptide

SEQ ID NO: 749 - protein, 221 aa, Artificial Sequence; identical to SEQ ID NO: 695
  Description of Artificial Sequence: Synthetic polypeptide

SEQ ID NO: 750 - protein, 683 aa, Artificial Sequence
  Description of Artificial Sequence: Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSHGMHWVRQPPGKGLEWVAVIWYDGSNEYYGDSVKGRFTISRDNSKNTLYLQMNSLRVEDTAVYYCTRGGGHWNYEGHYYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 751 - DNA, 642 bp, Artificial Sequence; identical to SEQ ID NO: 721
  Description of Artificial Sequence: Synthetic polynucleotide

SEQ ID NO: 752 - DNA, 648 bp, Artificial Sequence; identical to SEQ ID NO: 698
  Description of Artificial Sequence: Synthetic polynucleotide

SEQ ID NO: 753 - DNA, 2031 bp, Artificial Sequence
  Description of Artificial Sequence: Synthetic polynucleotide
caggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcgtggtccagcctgggaggtccctgagactctcctgtgcagcgtctggattcaccctcagtagctatggcatgcactgggtccgccaggctccaggcaaggggctggagtgggtggcagttatctggtatgatggaagtaataaatactatgcagactccgtgaagggccgagtcaccatctccagagacaattccaagaacacgctgtatctgcaaatgaatagcctgagagccgaggacacggctgtgtattactgtacgagagatggccggaactacgtctactttgacaactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 754 - protein, 214 aa, Artificial Sequence; identical to SEQ ID NO: 724
  Description of Artificial Sequence: Synthetic polypeptide

SEQ ID NO: 755 - protein, 216 aa, Artificial Sequence; identical to SEQ ID NO: 701
  Description of Artificial Sequence: Synthetic polypeptide

SEQ ID NO: 756 - protein, 677 aa, Artificial Sequence
  Description of Artificial Sequence: Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTLSSYGMHWVRQAPGKGLEWVAVIWYDGSNKYYADSVKGRVTISRDNSKNTLYLQMNSLRAEDTAVYYCTRDGRNYVYFDNWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 757 - DNA, 642 bp, Artificial Sequence; identical to SEQ ID NO: 721
  Description of Artificial Sequence: Synthetic polynucleotide

SEQ ID NO: 758 - DNA, 645 bp, Artificial Sequence; identical to SEQ ID NO: 704
  Description of Artificial Sequence: Synthetic polynucleotide

SEQ ID NO: 759 - DNA, 2031 bp, Artificial Sequence
  Description of Artificial Sequence: Synthetic polynucleotide
caggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagctgcaacagtcaggtccaggactggtgaagccctcgcagaccctctcactcacctgtgccatctccggggacagtgtctctagcagccgtactgcttggaactggatcaggcagtccccatcgagaggccttgagtggctgggaaggacatactacaggtccaagtggtatcatgattattcagtatctgtgaaaagtcgaatcaccatcgacccagacacatccaagaaccagttctccctgcagctgaactctgtgactcccgaggacacggctgtttattattgtgcaagaggggctgctccctttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 760 - protein, 214 aa, Artificial Sequence; identical to SEQ ID NO: 724
  Description of Artificial Sequence: Synthetic polypeptide

SEQ ID NO: 761 - protein, 215 aa, Artificial Sequence; identical to SEQ ID NO: 707
  Description of Artificial Sequence: Synthetic polypeptide

SEQ ID NO: 762 - protein, 677 aa, Artificial Sequence
  Description of Artificial Sequence: Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGPGLVKPSQTLSLTCAISGDSVSSSRTAWNWIRQSPSRGLEWLGRTYYRSKWYHDYSVSVKSRITIDPDTSKNQFSLQLNSVTPEDTAVYYCARGAAPFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 763 - DNA, 642 bp, Artificial Sequence; identical to SEQ ID NO: 721
  Description of Artificial Sequence: Synthetic polynucleotide

SEQ ID NO: 764 - DNA, 636 bp, Artificial Sequence; identical to SEQ ID NO: 710
  Description of Artificial Sequence: Synthetic polynucleotide

SEQ ID NO: 765 - DNA, 2037 bp, Artificial Sequence
  Description of Artificial Sequence: Synthetic polynucleotide
caggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttggtggagtctgggggaggcttagtcaagcctggagggtccctgagactctcctgtgcagcctctgaattcaccttcagtgactactacatgagctggatccgccaggctccagggaaggggctggagtgggtttcatatattagtcgaagtggtgataccatctactacgcagactctgtgaagggccgattcaccatctccagggacaacgccaagaactcactgtatctgcaaatgaatggcctgcgagccgaagacacggccgtgtattactgtgcgagagacttagcagcaggtgctacagggggccttgactgctggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 766 - protein, 214 aa, Artificial Sequence; identical to SEQ ID NO: 724
  Description of Artificial Sequence: Synthetic polypeptide

SEQ ID NO: 767 - protein, 212 aa, Artificial Sequence; identical to SEQ ID NO: 713
  Description of Artificial Sequence: Synthetic polypeptide

SEQ ID NO: 768 - protein, 679 aa, Artificial Sequence
  Description of Artificial Sequence: Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASEFTFSDYYMSWIRQAPGKGLEWVSYISRSGDTIYYADSVKGRFTISRDNAKNSLYLQMNGLRAEDTAVYYCARDLAAGATGGLDCWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 769 - DNA, 642 bp, Artificial Sequence
  Description of Artificial Sequence: Synthetic polynucleotide
gacatccagatgacccagtctccatcttccgtgtctgcttctgtcggagacagagtcaccatcacttgtcgggcgagtcaggatattagcaggtggttagcctggtatcagcagaaaccagggaaagcccctaagctcctgatttctgctgcatccagattgcaaagtggagtcccatcaaggttcagcggcagtggatctgggacagatttcactctcaccatcagcagcctgcagcctgaagattttgcaatttactattgtcaacaggctaaaagttttcctcggacgttcggccaagggaccaaggtggaaatcaaacggacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 770 - DNA, 651 bp, Artificial Sequence; identical to SEQ ID NO: 716
  Description of Artificial Sequence: Synthetic polynucleotide

SEQ ID NO: 771 - DNA, 2037 bp, Artificial Sequence
  Description of Artificial Sequence: Synthetic polynucleotide
caggtgcagctggtcgagtctgggggaggcttggtcaagcctggagggtccctgagactctcctgtgcagcctctggattcaccttcagtgactactacatgacctggatcaggcaggctccagggaaggggctggagtggatttcatacattagtagtagtggtagtaccatctactacgcagactctgtgaagggccgattcaccatctccagggacaacgccaagaactcactgtatctgcaaatgaacagcctgagagccgaggacacggccgtgtattactgtgcgagagatcggaactcccactttgactattggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtgcagtctgggactgaggtgaagaagcctggggcctcagtgaaggtgtcctgcaaggcttctggatacaccttccccggctactatatgcactgggtgcgacaggcccctggacaggggcttgagtggatgggatggatcaaccctgacagtggtggcacaaagtatacacagaagtttcagggcagggtcaccttgaccagggacgcgtccgtcagcacagcctacattgacctgaacaggctgagatctgacgacacggccgtatattactgtgcgagagagaggtgtaggactaccaactgctatttggactactggggccagggaagtctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 772 - protein, 214 aa, Artificial Sequence
  Description of Artificial Sequence: Synthetic polypeptide
DIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 773 - protein, 217 aa, Artificial Sequence; identical to SEQ ID NO: 719
  Description of Artificial Sequence: Synthetic polypeptide

SEQ ID NO: 774 - protein, 679 aa, Artificial Sequence
  Description of Artificial Sequence: Synthetic polypeptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGTEVKKPGASVKVSCKASGYTFPGYYMHWVRQAPGQGLEWMGWINPDSGGTKYTQKFQGRVTLTRDASVSTAYIDLNRLRSDDTAVYYCARERCRTTNCYLDYWGQGSLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 775 - DNA, 642 bp, Artificial Sequence; identical to SEQ ID NO: 769
  Description of Artificial Sequence: Synthetic polynucleotide

SEQ ID NO: 776 - DNA, 642 bp, Artificial Sequence; identical to SEQ ID NO: 668
  Description of Artificial Sequence: Synthetic polynucleotide

SEQ ID NO: 777 - DNA, 2037 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtgcagtctggggctgaggtgaagaagcctggggcctcagtgaaggtgtcctgcaaggcttctggatacaccttcgccggctactatatgcactgggtgcgacaggcccctggacaagggcttgagtggatgggatggatcaaccctgacagtggaggcacaaactttgcacagcagtttcagggcagggtcaccatgaccagggatacgtccatcagcacagcctacatggaggtgagcaggctgagatctgacgacacggccgtgttttactgtgcgagagagaagatcactatgactggtatttactttgactattggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 778 - protein, 214 aa, Artificial Sequence; identical to SEQ ID NO: 772
  Description of Artificial Sequence: Synthetic polypeptide

SEQ ID NO: 779 - protein, 214 aa, Artificial Sequence; identical to SEQ ID NO: 671
  Description of Artificial Sequence: Synthetic polypeptide

SEQ ID NO: 780 - protein, 679 aa, Artificial Sequence
  Description of Artificial Sequence: Synthetic polypeptide
QVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGAEVKKPGASVKVSCKASGYTFAGYYMHWVRQAPGQGLEWMGWINPDSGGTNFAQQFQGRVTMTRDTSISTAYMEVSRLRSDDTAVFYCAREKITMTGIYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 781 - DNA, 642 bp, Artificial Sequence; identical to SEQ ID NO: 769
  Description of Artificial Sequence: Synthetic polynucleotide

SEQ ID NO: 782 - DNA, 642 bp, Artificial Sequence; identical to SEQ ID NO: 674
  Description of Artificial Sequence: Synthetic polynucleotide

SEQ ID NO: 783 - DNA, 2049 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcaactggtgcagtctggggctgaggtgacgaagcctggggcctcagtgaaggtgtcctgcaaggcttctggatacaccttcgccggctactatatgcactgggtgcgacaggcccctggacaagggcttgagtggatgggatggatcaaccctcacagtggtggcacaaactatgcacagaagtttcaggacagggtcaccatgaccagggacacgtccatcaacacagcctacatggaactgagcaggctgagatctgacgacacggccgtgtattactgtgcgagagaacgtatttctatggttcggggagtcgggcacaactggttcgccccctggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 784 - protein, 214 aa, Artificial Sequence; identical to SEQ ID NO: 772
  Description of Artificial Sequence: Synthetic polypeptide

SEQ ID NO: 785 - protein, 214 aa, Artificial Sequence; identical to SEQ ID NO: 677
  Description of Artificial Sequence: Synthetic polypeptide

SEQ ID NO: 786 - protein, 683 aa, Artificial Sequence
  Description of Artificial Sequence: Synthetic polypeptide
QVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGAEVTKPGASVKVSCKASGYTFAGYYMHWVRQAPGQGLEWMGWINPHSGGTNYAQKFQDRVTMTRDTSINTAYMELSRLRSDDTAVYYCARERISMVRGVGHNWFAPWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 787 - DNA, 642 bp, Artificial Sequence; identical to SEQ ID NO: 769
  Description of Artificial Sequence: Synthetic polynucleotide

SEQ ID NO: 788 - DNA, 651 bp, Artificial Sequence; identical to SEQ ID NO: 680
  Description of Artificial Sequence: Synthetic polynucleotide

SEQ ID NO: 789 - DNA, 2034 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctgctggagtctgggggaggcttggtacagcctggggggtccctgagactctcctgtgcagcctctggattcacctttagtagaaatgccatgagttgggtccgccaggctccagggaaggggctggagtgggtgtcagctactggtggtagtggtattagcacatactacgcagactccgtgaagggccggttcaccatctccagagacaattccaagaacacgctgtatctgcaaatgaacagtctgagagccgaggacacggccgtatattactgtgcgagaggttatagcaacagctggtggtactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 790 - protein, 214 aa, Artificial Sequence; identical to SEQ ID NO: 772
  Description of Artificial Sequence: Synthetic polypeptide

SEQ ID NO: 791 - protein, 217 aa, Artificial Sequence; identical to SEQ ID NO: 683
  Description of Artificial Sequence: Synthetic polypeptide

SEQ ID NO: 792 - protein, 678 aa, Artificial Sequence
  Description of Artificial Sequence: Synthetic polypeptide
QVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLLESGGGLVQPGGSLRLSCAASGFTFSRNAMSWVRQAPGKGLEWVSATGGSGISTYYADSVKGRFTISRDNSKNTLYLQMNSLRAEDTAVYYCARGYSNSWWYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 793 - DNA, 642 bp, Artificial Sequence; identical to SEQ ID NO: 769
  Description of Artificial Sequence: Synthetic polynucleotide

SEQ ID NO: 794 - DNA, 642 bp, Artificial Sequence; identical to SEQ ID NO: 686
  Description of Artificial Sequence: Synthetic polynucleotide

SEQ ID NO: 795 - DNA, 2049 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcaactggtgcagtctggggctgaagtgaagaagcctggggcctcagtgaaggtgtcctgcaaggcttctggatacaccttccccggctactatatgtactggttgcgacaggcccctggacaaggacttgagtggatgggatggatcaaccctgacagtggtgacacaaactatgcacagaagtttcagggcagggtcaccatgaccagggacacgtccatcagcacagcctttatggagctgagcaggctgagatcagacgacacggccgtgtattactgtgcgagagagaagcccagatattttgactccttctactactaccttatggacgtctggggccaagggaccacggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 796 - protein, 214 aa, Artificial Sequence; identical to SEQ ID NO: 772
  Description of Artificial Sequence: Synthetic polypeptide

SEQ ID NO: 797 - protein, 214 aa, Artificial Sequence; identical to SEQ ID NO: 689
  Description of Artificial Sequence: Synthetic polypeptide

SEQ ID NO: 798 - protein, 683 aa, Artificial Sequence
  Description of Artificial Sequence: Synthetic polypeptide
QVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGAEVKKPGASVKVSCKASGYTFPGYYMYWLRQAPGQGLEWMGWINPDSGDTNYAQKFQGRVTMTRDTSISTAFMELSRLRSDDTAVYYCAREKPRYFDSFYYYLMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 799 - DNA, 642 bp, Artificial Sequence; identical to SEQ ID NO: 769
  Description of Artificial Sequence: Synthetic polynucleotide

SEQ ID NO: 800 - DNA, 663 bp, Artificial Sequence; identical to SEQ ID NO: 692
  Description of Artificial Sequence: Synthetic polynucleotide

SEQ ID NO: 801 - DNA, 2049 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttggtggagtctgggggaggcgtggtccagcctgggaggtccctgagactctcctgtgcagcgtctggattcaccttcagtagccatggcatgcactgggtccgccaacctccaggcaaggggctggagtgggtggcagttatctggtatgatggaagtaatgaatactatggagactccgtgaagggccgattcaccatctccagagacaattccaagaacacgctgtatctgcaaatgaacagcctgagagtcgaggacacggctgtgtattactgtacgagaggggggggccactggaactacgagggccactactatggtatggacgtctggggccaagggaccacggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 802 - protein, 214 aa, Artificial Sequence; identical to SEQ ID NO: 772
  Description of Artificial Sequence: Synthetic polypeptide

SEQ ID NO: 803 - protein, 221 aa, Artificial Sequence; identical to SEQ ID NO: 695
  Description of Artificial Sequence: Synthetic polypeptide

SEQ ID NO: 804 - protein, 683 aa, Artificial Sequence
  Description of Artificial Sequence: Synthetic polypeptide
QVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSHGMHWVRQPPGKGLEWVAVIWYDGSNEYYGDSVKGRFTISRDNSKNTLYLQMNSLRVEDTAVYYCTRGGGHWNYEGHYYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 805 - DNA, 642 bp, Artificial Sequence; identical to SEQ ID NO: 769
  Description of Artificial Sequence: Synthetic polynucleotide

SEQ ID NO: 806 - DNA, 648 bp, Artificial Sequence; identical to SEQ ID NO: 698
  Description of Artificial Sequence: Synthetic polynucleotide

SEQ ID NO: 807 - DNA, 2031 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcgtggtccagcctgggaggtccctgagactctcctgtgcagcgtctggattcaccctcagtagctatggcatgcactgggtccgccaggctccaggcaaggggctggagtgggtggcagttatctggtatgatggaagtaataaatactatgcagactccgtgaagggccgagtcaccatctccagagacaattccaagaacacgctgtatctgcaaatgaatagcctgagagccgaggacacggctgtgtattactgtacgagagatggccggaactacgtctactttgacaactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 808 - protein, 214 aa, Artificial Sequence; identical to SEQ ID NO: 772
  Description of Artificial Sequence: Synthetic polypeptide

SEQ ID NO: 809 - protein, 216 aa, Artificial Sequence; identical to SEQ ID NO: 701
  Description of Artificial Sequence: Synthetic polypeptide

SEQ ID NO: 810 - protein, 677 aa, Artificial Sequence
  Description of Artificial Sequence: Synthetic polypeptide
QVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTLSSYGMHWVRQAPGKGLEWVAVIWYDGSNKYYADSVKGRVTISRDNSKNTLYLQMNSLRAEDTAVYYCTRDGRNYVYFDNWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 811 - DNA, 642 bp, Artificial Sequence; identical to SEQ ID NO: 769
  Description of Artificial Sequence: Synthetic polynucleotide

SEQ ID NO: 812 - DNA, 645 bp, Artificial Sequence; identical to SEQ ID NO: 704
  Description of Artificial Sequence: Synthetic polynucleotide

SEQ ID NO: 813 - DNA, 2031 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagctgcaacagtcaggtccaggactggtgaagccctcgcagaccctctcactcacctgtgccatctccggggacagtgtctctagcagccgtactgcttggaactggatcaggcagtccccatcgagaggccttgagtggctgggaaggacatactacaggtccaagtggtatcatgattattcagtatctgtgaaaagtcgaatcaccatcgacccagacacatccaagaaccagttctccctgcagctgaactctgtgactcccgaggacacggctgtttattattgtgcaagaggggctgctccctttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 814 - protein, 214 aa, Artificial Sequence; identical to SEQ ID NO: 772
  Description of Artificial Sequence: Synthetic polypeptide

SEQ ID NO: 815 - protein, 215 aa, Artificial Sequence; identical to SEQ ID NO: 707
  Description of Artificial Sequence: Synthetic polypeptide

SEQ ID NO: 816 - protein, 677 aa, Artificial Sequence
  Description of Artificial Sequence: Synthetic polypeptide
QVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGPGLVKPSQTLSLTCAISGDSVSSSRTAWNWIRQSPSRGLEWLGRTYYRSKWYHDYSVSVKSRITIDPDTSKNQFSLQLNSVTPEDTAVYYCARGAAPFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 817 - DNA, 642 bp, Artificial Sequence; identical to SEQ ID NO: 769
  Description of Artificial Sequence: Synthetic polynucleotide

SEQ ID NO: 818 - DNA, 636 bp, Artificial Sequence; identical to SEQ ID NO: 710
  Description of Artificial Sequence: Synthetic polynucleotide

SEQ ID NO: 819 - DNA, 2037 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttggtggagtctgggggaggcttagtcaagcctggagggtccctgagactctcctgtgcagcctctgaattcaccttcagtgactactacatgagctggatccgccaggctccagggaaggggctggagtgggtttcatatattagtcgaagtggtgataccatctactacgcagactctgtgaagggccgattcaccatctccagggacaacgccaagaactcactgtatctgcaaatgaatggcctgcgagccgaagacacggccgtgtattactgtgcgagagacttagcagcaggtgctacagggggccttgactgctggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 820 - protein, 214 aa, Artificial Sequence; identical to SEQ ID NO: 772
  Description of Artificial Sequence: Synthetic polypeptide

SEQ ID NO: 821 - protein, 212 aa, Artificial Sequence; identical to SEQ ID NO: 713
  Description of Artificial Sequence: Synthetic polypeptide

SEQ ID NO: 822 - protein, 679 aa, Artificial Sequence
  Description of Artificial Sequence: Synthetic polypeptide
QVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASEFTFSDYYMSWIRQAPGKGLEWVSYISRSGDTIYYADSVKGRFTISRDNAKNSLYLQMNGLRAEDTAVYYCARDLAAGATGGLDCWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 823 - DNA, 660 bp, Artificial Sequence
  Description of Artificial Sequence: Synthetic polynucleotide
gacattgtgatgactcagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgagaatccggggtccctgaccgattcagtggcagcgggtctgggacagatttcactctcaccatcagcagcctgcaggctgaagatgtggcagtttattactgtcagcaatattatagtactcctccgacgttcggccaagggaccaaggtggagatcaaacggacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 824 - DNA, 651 bp, Artificial Sequence; identical to SEQ ID NO: 716
  Description of Artificial Sequence: Synthetic polynucleotide

SEQ ID NO: 825 - DNA, 2037 bp, Artificial Sequence
  Description of Artificial Sequence: Synthetic polynucleotide
caggtgcagctggtggagtctgggggaggcttggtcaagcctggagggtccctgagactctcctgtgcagcctctggattcaccttcagtgactactacatgagctggatccgccaggctccagggaaggggctggagtggatttcatacattagtagcagtgaaagtatcatctattacgtagactctgtgaagggccgattcaccatctccagggacaacgccaagaactcactgtatctgcaaatgaacagcctgagagccgaggacacggccgtgtattactgtgcgagagatgttgggagccactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtgcagtctgggactgaggtgaagaagcctggggcctcagtgaaggtgtcctgcaaggcttctggatacaccttccccggctactatatgcactgggtgcgacaggcccctggacaggggcttgagtggatgggatggatcaaccctgacagtggtggcacaaagtatacacagaagtttcagggcagggtcaccttgaccagggacgcgtccgtcagcacagcctacattgacctgaacaggctgagatctgacgacacggccgtatattactgtgcgagagagaggtgtaggactaccaactgctatttggactactggggccagggaagtctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 826 - protein, 220 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 827 - protein, 217 aa, Artificial Sequence; identical to SEQ ID NO: 719
  Description of Artificial Sequence: Synthetic polypeptide

SEQ ID NO: 828 - protein, 679 aa, Artificial Sequence
  Description of Artificial Sequence: Synthetic polypeptide
QVQLVESGGGLVKPGGSLRLSCAASGFTFSDYYMSWIRQAPGKGLEWISYISSSESIIYYVDSVKGRFTISRDNAKNSLYLQMNSLRAEDTAVYYCARDVGSHFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGTEVKKPGASVKVSCKASGYTFPGYYMHWVRQAPGQGLEWMGWINPDSGGTKYTQKFQGRVTLTRDASVSTAYIDLNRLRSDDTAVYYCARERCRTTNCYLDYWGQGSLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 829 - DNA, 660 bp, Artificial Sequence; identical to SEQ ID NO: 823
  Description of Artificial Sequence: Synthetic polynucleotide

SEQ ID NO: 830 - DNA, 642 bp, Artificial Sequence; identical to SEQ ID NO: 668
  Description of Artificial Sequence: Synthetic polynucleotide

SEQ ID NO: 831 - DNA, 2040 bp, Artificial Sequence
  Description of Artificial Sequence: Synthetic polynucleotide
gaggtgcagctggtcgagtctggaggaggcttgatccagcctggggggtccctgagactctcctgtgcagtctctgggttcaccgtcagtagcaagttcatgacctgggtccgccaggctccagggaaggggctggagtgggtgtcagttatttatagcggtggtaagacatactacgcagactccgtgaagggccgattcaccatctccagagacaattccaagaacacgctgtatcttcaaatgaacagcctgagagccgaggacacggccgtgtattactgtgcgagagatagcggtggctgggggtactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtgcagtctggggctgaggtgaagaagcctggggcctcagtgaaggtgtcctgcaaggcttctggatacaccttcgccggctactatatgcactgggtgcgacaggcccctggacaagggcttgagtggatgggatggatcaaccctgacagtggaggcacaaactttgcacagcagtttcagggcagggtcaccatgaccagggatacgtccatcagcacagcctacatggaggtgagcaggctgagatctgacgacacggccgtgttttactgtgcgagagagaagatcactatgactggtatttactttgactattggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 832 - protein, 220 aa, Artificial Sequence; identical to SEQ ID NO: 826
  Description of Artificial Sequence: Synthetic polypeptide

SEQ ID NO: 833 - protein, 214 aa, Artificial Sequence; identical to SEQ ID NO: 671
  Description of Artificial Sequence: Synthetic polypeptide

SEQ ID NO: 834 - protein, 680 aa, Artificial Sequence
  Description of Artificial Sequence: Synthetic polypeptide
EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGAEVKKPGASVKVSCKASGYTFAGYYMHWVRQAPGQGLEWMGWINPDSGGTNFAQQFQGRVTMTRDTSISTAYMEVSRLRSDDTAVFYCAREKITMTGIYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 835 - DNA, 660 bp, Artificial Sequence; identical to SEQ ID NO: 823
  Description of Artificial Sequence: Synthetic polynucleotide

SEQ ID NO: 836 - DNA, 642 bp, Artificial Sequence; identical to SEQ ID NO: 674
  Description of Artificial Sequence: Synthetic polynucleotide

SEQ ID NO: 837 - DNA, 2052 bp, Artificial Sequence
  Description of Artificial Sequence: Synthetic polynucleotide
gaggtgcagctggtcgagtctggaggaggcttgatccagcctggggggtccctgagactctcctgtgcagtctctgggttcaccgtcagtagcaagttcatgacctgggtccgccaggctccagggaaggggctggagtgggtgtcagttatttatagcggtggtaagacatactacgcagactccgtgaagggccgattcaccatctccagagacaattccaagaacacgctgtatcttcaaatgaacagcctgagagccgaggacacggccgtgtattactgtgcgagagatagcggtggctgggggtactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcaactggtgcagtctggggctgaggtgacgaagcctggggcctcagtgaaggtgtcctgcaaggcttctggatacaccttcgccggctactatatgcactgggtgcgacaggcccctggacaagggcttgagtggatgggatggatcaaccctcacagtggtggcacaaactatgcacagaagtttcaggacagggtcaccatgaccagggacacgtccatcaacacagcctacatggaactgagcaggctgagatctgacgacacggccgtgtattactgtgcgagagaacgtatttctatggttcggggagtcgggcacaactggttcgccccctggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 838 - protein, 220 aa, Artificial Sequence; identical to SEQ ID NO: 826
  Description of Artificial Sequence: Synthetic polypeptide

SEQ ID NO: 839 - protein, 214 aa, Artificial Sequence; identical to SEQ ID NO: 677
  Description of Artificial Sequence: Synthetic polypeptide

SEQ ID NO: 840 - protein, 684 aa, Artificial Sequence
  Description of Artificial Sequence: Synthetic polypeptide
EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGAEVTKPGASVKVSCKASGYTFAGYYMHWVRQAPGQGLEWMGWINPHSGGTNYAQKFQDRVTMTRDTSINTAYMELSRLRSDDTAVYYCARERISMVRGVGHNWFAPWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 841 - DNA, 660 bp, Artificial Sequence; identical to SEQ ID NO: 823
  Description of Artificial Sequence: Synthetic polynucleotide

SEQ ID NO: 842 - DNA, 651 bp, Artificial Sequence; identical to SEQ ID NO: 680
  Description of Artificial Sequence: Synthetic polynucleotide

SEQ ID NO: 843 - DNA, 2037 bp, Artificial Sequence
  Description of Artificial Sequence: Synthetic polynucleotide
gaggtgcagctggtcgagtctggaggaggcttgatccagcctggggggtccctgagactctcctgtgcagtctctgggttcaccgtcagtagcaagttcatgacctgggtccgccaggctccagggaaggggctggagtgggtgtcagttatttatagcggtggtaagacatactacgcagactccgtgaagggccgattcaccatctccagagacaattccaagaacacgctgtatcttcaaatgaacagcctgagagccgaggacacggccgtgtattactgtgcgagagatagcggtggctgggggtactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctgctggagtctgggggaggcttggtacagcctggggggtccctgagactctcctgtgcagcctctggattcacctttagtagaaatgccatgagttgggtccgccaggctccagggaaggggctggagtgggtgtcagctactggtggtagtggtattagcacatactacgcagactccgtgaagggccggttcaccatctccagagacaattccaagaacacgctgtatctgcaaatgaacagtctgagagccgaggacacggccgtatattactgtgcgagaggttatagcaacagctggtggtactttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 844 - protein, 220 aa, Artificial Sequence; identical to SEQ ID NO: 826
  Description of Artificial Sequence: Synthetic polypeptide

SEQ ID NO: 845 - protein, 217 aa, Artificial Sequence; identical to SEQ ID NO: 683
  Description of Artificial Sequence: Synthetic polypeptide

SEQ ID NO: 846 - protein, 679 aa, Artificial Sequence
  Description of Artificial Sequence: Synthetic polypeptide
EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLLESGGGLVQPGGSLRLSCAASGFTFSRNAMSWVRQAPGKGLEWVSATGGSGISTYYADSVKGRFTISRDNSKNTLYLQMNSLRAEDTAVYYCARGYSNSWWYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 847 - DNA, 660 bp, Artificial Sequence; identical to SEQ ID NO: 823
  Description of Artificial Sequence: Synthetic polynucleotide

SEQ ID NO: 848 - DNA, 642 bp, Artificial Sequence; identical to SEQ ID NO: 686
  Description of Artificial Sequence: Synthetic polynucleotide

SEQ ID NO: 849 - DNA, 2052 bp, Artificial Sequence
  Description of Artificial Sequence: Synthetic polynucleotide
gaggtgcagctggtcgagtctggaggaggcttgatccagcctggggggtccctgagactctcctgtgcagtctctgggttcaccgtcagtagcaagttcatgacctgggtccgccaggctccagggaaggggctggagtgggtgtcagttatttatagcggtggtaagacatactacgcagactccgtgaagggccgattcaccatctccagagacaattccaagaacacgctgtatcttcaaatgaacagcctgagagccgaggacacggccgtgtattactgtgcgagagatagcggtggctgggggtactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcaactggtgcagtctggggctgaagtgaagaagcctggggcctcagtgaaggtgtcctgcaaggcttctggatacaccttccccggctactatatgtactggttgcgacaggcccctggacaaggacttgagtggatgggatggatcaaccctgacagtggtgacacaaactatgcacagaagtttcagggcagggtcaccatgaccagggacacgtccatcagcacagcctttatggagctgagcaggctgagatcagacgacacggccgtgtattactgtgcgagagagaagcccagatattttgactccttctactactaccttatggacgtctggggccaagggaccacggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 850 - protein, 220 aa, Artificial Sequence; identical to SEQ ID NO: 826
  Description of Artificial Sequence: Synthetic polypeptide

SEQ ID NO: 851 - protein, 214 aa, Artificial Sequence; identical to SEQ ID NO: 689
  Description of Artificial Sequence: Synthetic polypeptide

SEQ ID NO: 852 - protein, 684 aa, Artificial Sequence
  Description of Artificial Sequence: Synthetic polypeptide
EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGAEVKKPGASVKVSCKASGYTFPGYYMYWLRQAPGQGLEWMGWINPDSGDTNYAQKFQGRVTMTRDTSISTAFMELSRLRSDDTAVYYCAREKPRYFDSFYYYLMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 853 - DNA, 660 bp, Artificial Sequence; identical to SEQ ID NO: 823
  Description of Artificial Sequence: Synthetic polynucleotide

SEQ ID NO: 854 - DNA, 663 bp, Artificial Sequence; identical to SEQ ID NO: 692
  Description of Artificial Sequence: Synthetic polynucleotide

SEQ ID NO: 855 - DNA, 2052 bp, Artificial Sequence
  Description of Artificial Sequence: Synthetic polynucleotide
gaggtgcagctggtcgagtctggaggaggcttgatccagcctggggggtccctgagactctcctgtgcagtctctgggttcaccgtcagtagcaagttcatgacctgggtccgccaggctccagggaaggggctggagtgggtgtcagttatttatagcggtggtaagacatactacgcagactccgtgaagggccgattcaccatctccagagacaattccaagaacacgctgtatcttcaaatgaacagcctgagagccgaggacacggccgtgtattactgtgcgagagatagcggtggctgggggtactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttggtggagtctgggggaggcgtggtccagcctgggaggtccctgagactctcctgtgcagcgtctggattcaccttcagtagccatggcatgcactgggtccgccaacctccaggcaaggggctggagtgggtggcagttatctggtatgatggaagtaatgaatactatggagactccgtgaagggccgattcaccatctccagagacaattccaagaacacgctgtatctgcaaatgaacagcctgagagtcgaggacacggctgtgtattactgtacgagaggggggggccactggaactacgagggccactactatggtatggacgtctggggccaagggaccacggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 856 - protein, 220 aa, Artificial Sequence; identical to SEQ ID NO: 826
  Description of Artificial Sequence: Synthetic polypeptide

SEQ ID NO: 857 - protein, 221 aa, Artificial Sequence; identical to SEQ ID NO: 695
  Description of Artificial Sequence: Synthetic polypeptide

SEQ ID NO: 858 - protein, 684 aa, Artificial Sequence
  Description of Artificial Sequence: Synthetic polypeptide
EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSHGMHWVRQPPGKGLEWVAVIWYDGSNEYYGDSVKGRFTISRDNSKNTLYLQMNSLRVEDTAVYYCTRGGGHWNYEGHYYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 859 - DNA, 660 bp, Artificial Sequence; identical to SEQ ID NO: 823
  Description of Artificial Sequence: Synthetic polynucleotide

SEQ ID NO: 860 - DNA, 648 bp, Artificial Sequence; identical to SEQ ID NO: 698
  Description of Artificial Sequence: Synthetic polynucleotide

SEQ ID NO: 861 - DNA, 2034 bp, Artificial Sequence
  Description of Artificial Sequence: Synthetic polynucleotide
gaggtgcagctggtcgagtctggaggaggcttgatccagcctggggggtccctgagactctcctgtgcagtctctgggttcaccgtcagtagcaagttcatgacctgggtccgccaggctccagggaaggggctggagtgggtgtcagttatttatagcggtggtaagacatactacgcagactccgtgaagggccgattcaccatctccagagacaattccaagaacacgctgtatcttcaaatgaacagcctgagagccgaggacacggccgtgtattactgtgcgagagatagcggtggctgggggtactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtggagtctgggggaggcgtggtccagcctgggaggtccctgagactctcctgtgcagcgtctggattcaccctcagtagctatggcatgcactgggtccgccaggctccaggcaaggggctggagtgggtggcagttatctggtatgatggaagtaataaatactatgcagactccgtgaagggccgagtcaccatctccagagacaattccaagaacacgctgtatctgcaaatgaatagcctgagagccgaggacacggctgtgtattactgtacgagagatggccggaactacgtctactttgacaactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 862 - protein, 220 aa, Artificial Sequence; identical to SEQ ID NO: 826
  Description of Artificial Sequence: Synthetic polypeptide

SEQ ID NO: 863 - protein, 216 aa, Artificial Sequence; identical to SEQ ID NO: 701
  Description of Artificial Sequence: Synthetic polypeptide

SEQ ID NO: 864 - protein, 678 aa, Artificial Sequence
  Description of Artificial Sequence: Synthetic polypeptide
EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTLSSYGMHWVRQAPGKGLEWVAVIWYDGSNKYYADSVKGRVTISRDNSKNTLYLQMNSLRAEDTAVYYCTRDGRNYVYFDNWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 865 - DNA, 660 bp, Artificial Sequence; identical to SEQ ID NO: 823
  Description of Artificial Sequence: Synthetic polynucleotide

SEQ ID NO: 866 - DNA, 645 bp, Artificial Sequence; identical to SEQ ID NO: 704
  Description of Artificial Sequence: Synthetic polynucleotide

SEQ ID NO: 867 - DNA, 2034 bp, Artificial Sequence
  Description of Artificial Sequence: Synthetic polynucleotide
gaggtgcagctggtcgagtctggaggaggcttgatccagcctggggggtccctgagactctcctgtgcagtctctgggttcaccgtcagtagcaagttcatgacctgggtccgccaggctccagggaaggggctggagtgggtgtcagttatttatagcggtggtaagacatactacgcagactccgtgaagggccgattcaccatctccagagacaattccaagaacacgctgtatcttcaaatgaacagcctgagagccgaggacacggccgtgtattactgtgcgagagatagcggtggctgggggtactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagctgcaacagtcaggtccaggactggtgaagccctcgcagaccctctcactcacctgtgccatctccggggacagtgtctctagcagccgtactgcttggaactggatcaggcagtccccatcgagaggccttgagtggctgggaaggacatactacaggtccaagtggtatcatgattattcagtatctgtgaaaagtcgaatcaccatcgacccagacacatccaagaaccagttctccctgcagctgaactctgtgactcccgaggacacggctgtttattattgtgcaagaggggctgctccctttgactactggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 868 - protein, 220 aa, Artificial Sequence; identical to SEQ ID NO: 826
  Description of Artificial Sequence: Synthetic polypeptide

SEQ ID NO: 869 - protein, 215 aa, Artificial Sequence; identical to SEQ ID NO: 707
  Description of Artificial Sequence: Synthetic polypeptide

SEQ ID NO: 870 - protein, 678 aa, Artificial Sequence
  Description of Artificial Sequence: Synthetic polypeptide
EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGPGLVKPSQTLSLTCAISGDSVSSSRTAWNWIRQSPSRGLEWLGRTYYRSKWYHDYSVSVKSRITIDPDTSKNQFSLQLNSVTPEDTAVYYCARGAAPFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 871 - DNA, 660 bp, Artificial Sequence; identical to SEQ ID NO: 823
  Description of Artificial Sequence: Synthetic polynucleotide

SEQ ID NO: 872 - DNA, 636 bp, Artificial Sequence; identical to SEQ ID NO: 710
  Description of Artificial Sequence: Synthetic polynucleotide

SEQ ID NO: 873 - DNA, 2040 bp, Artificial Sequence
  Description of Artificial Sequence: Synthetic polynucleotide
gaggtgcagctggtcgagtctggaggaggcttgatccagcctggggggtccctgagactctcctgtgcagtctctgggttcaccgtcagtagcaagttcatgacctgggtccgccaggctccagggaaggggctggagtgggtgtcagttatttatagcggtggtaagacatactacgcagactccgtgaagggccgattcaccatctccagagacaattccaagaacacgctgtatcttcaaatgaacagcctgagagccgaggacacggccgtgtattactgtgcgagagatagcggtggctgggggtactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttggtggagtctgggggaggcttagtcaagcctggagggtccctgagactctcctgtgcagcctctgaattcaccttcagtgactactacatgagctggatccgccaggctccagggaaggggctggagtgggtttcatatattagtcgaagtggtgataccatctactacgcagactctgtgaagggccgattcaccatctccagggacaacgccaagaactcactgtatctgcaaatgaatggcctgcgagccgaagacacggccgtgtattactgtgcgagagacttagcagcaggtgctacagggggccttgactgctggggccagggaaccctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 874 - protein, 220 aa, Artificial Sequence; identical to SEQ ID NO: 826
  Description of Artificial Sequence: Synthetic polypeptide

SEQ ID NO: 875 - protein, 212 aa, Artificial Sequence; identical to SEQ ID NO: 713
  Description of Artificial Sequence: Synthetic polypeptide

SEQ ID NO: 876 - protein, 680 aa, Artificial Sequence
  Description of Artificial Sequence: Synthetic polypeptide
EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGLVKPGGSLRLSCAASEFTFSDYYMSWIRQAPGKGLEWVSYISRSGDTIYYADSVKGRFTISRDNAKNSLYLQMNGLRAEDTAVYYCARDLAAGATGGLDCWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 877 - DNA, 660 bp, Artificial Sequence; identical to SEQ ID NO: 823
  Description of Artificial Sequence: Synthetic polynucleotide

SEQ ID NO: 878 - DNA, 651 bp, Artificial Sequence; identical to SEQ ID NO: 716
  Description of Artificial Sequence: Synthetic polynucleotide

SEQ ID NO: 879 - DNA, 2040 bp, Artificial Sequence
  Description of Artificial Sequence: Synthetic polynucleotide
gaggtgcagctggtcgagtctggaggaggcttgatccagcctggggggtccctgagactctcctgtgcagtctctgggttcaccgtcagtagcaagttcatgacctgggtccgccaggctccagggaaggggctggagtgggtgtcagttatttatagcggtggtaagacatactacgcagactccgtgaagggccgattcaccatctccagagacaattccaagaacacgctgtatcttcaaatgaacagcctgagagccgaggacacggccgtgtattactgtgcgagagatagcggtggctgggggtactttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctggtgcagtctgggactgaggtgaagaagcctggggcctcagtgaaggtgtcctgcaaggcttctggatacaccttccccggctactatatgcactgggtgcgacaggcccctggacaggggcttgagtggatgggatggatcaaccctgacagtggtggcacaaagtatacacagaagtttcagggcagggtcaccttgaccagggacgcgtccgtcagcacagcctacattgacctgaacaggctgagatctgacgacacggccgtatattactgtgcgagagagaggtgtaggactaccaactgctatttggactactggggccagggaagtctggtcaccgtgtcctcagcaagcacgaaggggccgtccgtatttccgcttgcgccctcgtcgaagtcaacttcgggagggaccgcggcacttggctgtcttgtcaaagattacttccctgagccagtgacagtcagctggaattccggtgccctcacgtcaggagtacatacattccctgcggtattgcagtcctccggactctactccctggagtcggtggtaacggtgcccagctccagcttggggacccagacgtacatttgtaacgtgaatcacaaaccaagcaatactaaggtagataagaaagtagaaccgaagagctgc

SEQ ID NO: 880 - protein, 220 aa, Artificial Sequence; identical to SEQ ID NO: 826
  Description of Artificial Sequence: Synthetic polypeptide

SEQ ID NO: 881 - protein, 217 aa, Artificial Sequence; identical to SEQ ID NO: 719
  Description of Artificial Sequence: Synthetic polypeptide

SEQ ID NO: 882 - protein, 680 aa, Artificial Sequence
  Description of Artificial Sequence: Synthetic polypeptide
EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVQSGTEVKKPGASVKVSCKASGYTFPGYYMHWVRQAPGQGLEWMGWINPDSGGTKYTQKFQGRVTLTRDASVSTAYIDLNRLRSDDTAVYYCARERCRTTNCYLDYWGQGSLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 883 - protein, 107 aa, Homo sapiens [sequence omitted]

SEQ ID NO: 884 - protein, 106 aa, Homo sapiens
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 885 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 886 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGG

SEQ ID NO: 887 - protein, 8 aa, Artificial Sequence
  Description of Artificial Sequence: Synthetic peptide
GGSGGGGS

SEQ ID NO: 888 - protein, 10 aa, Artificial Sequence
  Description of Artificial Sequence: Synthetic peptide
GGGGSGGGGS

SEQ ID NO: 889 - protein, 15 aa, Artificial Sequence
  Description of Artificial Sequence: Synthetic peptide
GGGGSGGGGSGGGGS

SEQ ID NO: 890 - protein, 20 aa, Artificial Sequence
  Description of Artificial Sequence: Synthetic peptide
GGGGSGGGGSGGGGSGGGGS

SEQ ID NO: 891 - protein, 10 aa, Artificial Sequence
  Description of Artificial Sequence: Synthetic peptide
GGGGQGGGGQ

SEQ ID NO: 892 - protein, 15 aa, Artificial Sequence
  Description of Artificial Sequence: Synthetic peptide
GGGGQGGGGQGGGGQ

SEQ ID NO: 893 - protein, 20 aa, Artificial Sequence
  Description of Artificial Sequence: Synthetic peptide
GGGGQGGGGQGGGGQGGGGQ

SEQ ID NO: 894 - protein, 22 aa, Artificial Sequence
  Description of Artificial Sequence: Synthetic peptide
MDMRVPAQLLGLLLLWLRGARC

SEQ ID NO: 895 - protein, 19 aa, Artificial Sequence
  Description of Artificial Sequence: Synthetic peptide
MAWALLLLTLLTQGTGSWA

SEQ ID NO: 896 - protein, 19 aa, Artificial Sequence
  Description of Artificial Sequence: Synthetic peptide
MTCSPLLLTLLIHCTGSWA

SEQ ID NO: 897 - protein, 20 aa, Artificial Sequence
  Description of Artificial Sequence: Synthetic peptide
MEAPAQLLFLLLLWLPDTTG

SEQ ID NO: 898 - protein, 19 aa, Artificial Sequence
  Description of Artificial Sequence: Synthetic peptide
MEWTWRVLFLVAAATGAHS

SEQ ID NO: 899 - protein, 20 aa, Artificial Sequence
  Description of Artificial Sequence: Synthetic peptide
METPAQLLFLLLLWLPDTTG

SEQ ID NO: 900 - protein, 20 aa, Artificial Sequence
  Description of Artificial Sequence: Synthetic peptide
METPAQLLFLLLLWLPDTTG

SEQ ID NO: 901 - protein, 19 aa, Artificial Sequence
  Description of Artificial Sequence: Synthetic peptide
MKHLWFFLLLVAAPRWVLS

SEQ ID NO: 902 - protein, 19 aa, Artificial Sequence
  Description of Artificial Sequence: Synthetic peptide
MEWSWVFLFFLSVTTGVHS

SEQ ID NO: 903 - protein, 629 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQAPRRPLPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 904 - protein, 621 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTHFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSVQEALSGTPCLLGPGPVLTVLALLLASTLA

SEQ ID NO: 905 - protein, 620 aa, Macaca fascicularis
MALPMARPLSGSCGTPALGSLLFLLFSLGWVQPSRVLAGETRQEAAPLDGILTNAPDIASLSPRQLLGFTCVEVSGLSTELVQELAVALGQKNVKLSAEQLRCLAHRLSEPPEDLDALPLDLLLFLNPDAFSGPQACTHFFSRVAKANVDLLPRGAPERQRLLPAALTCWGVRGSLLSEADVRALGGLACDLPGRFVAESAEWLPRLVRCLGPLDQDQQEAARAALQRGGPPYGPPSTWSISTLDDLQSLLPVLGQPVIHSIPQGILAAWRQRSSRDPSWQQPEQTVLRPRFRRDVERTTCPPEKEVHEIDENLIFYKKRELEACVDAALLAAQMDRVDAIPFTYEQLDVLKHKLDELYPQGYPESVIRHLGHLFLKMSPEDIRKWNVTSLETLKALLKVSKGHEMSAQVATLIDRVWGRGQLDKDTADTLTAFCPGCLCSLSPERLSSVPPSVIGAVRPQDLDTCGPRQLDVLYPKARLAFQNMSGSEYFVKIRPFLGGAPTEDLKALSQQNVSMDLATFMKLRREAVLPLTVAEVQKLLGPHVEGLKVEEQHSPVRDWILKQRQDDLDTLGLGLQGGIPNGYLILDLSVREALSGTPCLLGPGPVLTILALLLASTLA

SEQ ID NO: 906 - protein, 107 aa, Artificial Sequence
  Description of Artificial Sequence: Synthetic polypeptide
RTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 907 - protein, 107 aa, Artificial Sequence
  Description of Artificial Sequence: Synthetic polypeptide
RTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 908 - protein, 106 aa, Artificial Sequence
  Description of Artificial Sequence: Synthetic polypeptide
GQPKAAPSVTLFPPSSEELQANKATLVCLISDFYPGAVTVAWKADSSPVKAGVETTTPSKQSNNKYAAKSYLSLTPEQWKSHRSYSCQVTHEGSTVEKTVAPTECS

SEQ ID NO: 909 - protein, 106 aa, Artificial Sequence
  Description of Artificial Sequence: Synthetic polypeptide
GQPKAAPSVTLFPPSSEELQANKATLVCLISDFYPGAVTVAWKADSSPVKAGVETTTPSKQSNNKYAAESYLSLTPEQWKSHRSYSCQVTHEGSTVEKTVAPTECS

SEQ ID NO: 910 - protein, 622 aa, Macaca fascicularis
MALPMARPLSGSCGTPALGSLLFLLFSLGWVQPSRVLAGETRQEAAPLDGILTNAPDIASLSPRQLLGFTCVEVSGLSTELVQELAVALGQKNVKLSAEQLRCLAHRLSEPPEDLDALPLDLLLFLNPDAFSGPQACTHFFSRVAKANVDLLPRGAPERQRLLPAALTCWGVRGSLLSEADVRALGGLACDLPGRFVAESAEVVLPRLVRCLGPLDQDQQEAARAALQRGGPPYGPPSTWSISTLDDLQSLLPVLGQPVIHSIPQGILAAWRQRSSRDPSWQQPEQTVLRPRFRRDVERTTCPPEKEVHEIDESLIFYKKRELEACVDAALLAAQMDRVDAIPFTYEQLDVLKHKLDELYPQGYPESVIRHLGHLFLKMSPEDIRKWNVTSLETLKALLKVSKGHEMSAQVATLIDRVVVGRGQLDKDTADTLTAFCPGCLCSLSPERLSSVPPSIIGAVRPQDLDTCGPRQLDVLYPKARLAFQNMSGSEYFVKIRPFLGGAPTEDLKALSQQNVSMDLATFMKLRREAVLPLSVAEVQKLLGPHVEGLKVEEQHSPVRDWILKQRQDDLDTLGLGLQGGIPNGYLILDLSVREALSGTPCLLGPGPVLTVLALLLASTLA

SEQ ID NO: 911 - protein, 282 aa, Macaca fascicularis
MVRLPLQCVLWGCLLTAVYPEPPTACREKQYLINSQCCSLCQPGQKLVSDCTEFTETECLPCGESEFLDTWNRETRCHQHKYCDPNLGLRVQQKGTSETDTICTCEEGLHCTSESCESCVPHRSCLPGFGVKQIATGVSDTICEPCPVGFFSNVSSAFEKCRPWTSCETKDLVVQQAGTNKTDVVCGPQDRQRALVVIPICLGILFVILLLVLVFISESSEKVAKKPNDKVPHPKQEPQEINFPDDLPGSNPAAPVQETLHGCQPVTQEDGKESRISVQERQ

SEQ ID NO: 912 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGG

SEQ ID NO: 913 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGG

SEQ ID NO: 914 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 915 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 916 - protein, 8 aa, Artificial Sequence
  Description of Artificial Sequence: Synthetic peptide
GGGSGGGS

SEQ ID NO: 917 - protein, 12 aa, Artificial Sequence
  Description of Artificial Sequence: Synthetic peptide
GGGSGGGSGGGS

SEQ ID NO: 918 - protein, 16 aa, Artificial Sequence
  Description of Artificial Sequence: Synthetic peptide
GGGSGGGSGGGSGGGS

SEQ ID NO: 919 - protein, 20 aa, Artificial Sequence
  Description of Artificial Sequence: Synthetic peptide
GGGSGGGSGGGSGGGSGGGS

SEQ ID NO: 920 - protein, 25 aa, Artificial Sequence
  Description of Artificial Sequence: Synthetic peptide
GGGGSGGGGSGGGGSGGGGSGGGGS

SEQ ID NO: 921 - protein, 24 aa, Artificial Sequence
  Description of Artificial Sequence: Synthetic peptide
GGGSGGGSGGGSGGGSGGGSGGGS

SEQ ID NO: 922 - protein, 30 aa, Artificial Sequence
  Description of Artificial Sequence: Synthetic polypeptide
GGGGSGGGGSGGGGSGGGGSGGGGSGGGGS

SEQ ID NO: 923 - protein, 30 aa, Artificial Sequence; identical to SEQ ID NO: 922
  Description of Artificial Sequence: Synthetic polypeptide
  MISC_FEATURE (1)..(4): This region may encompass 3-4 residues
  MISC_FEATURE (6)..(9): This region may encompass 3-4 residues
  MISC_FEATURE (11)..(14): This region may encompass 3-4 residues
  MISC_FEATURE (16)..(19): This region may encompass 3-4 residues
  MISC_FEATURE (21)..(24): This region may encompass 3-4 residues
  MISC_FEATURE (26)..(29): This region may encompass 3-4 residues
  MISC_FEATURE (1)..(30): This sequence may encompass 1-6 "(Gly)x Ser" repeating units, wherein x = 3 or 4

SEQ ID NO: 924 - protein, 9 aa, Artificial Sequence
  Description of Artificial Sequence: Synthetic peptide
GGGSGGGGS

SEQ ID NO: 925 - protein, 6 aa, Artificial Sequence
  Description of Artificial Sequence: Synthetic 6xHis tag
HHHHHH

SEQ ID NO: 926 - protein, 107 aa, Artificial Sequence; identical to SEQ ID NO: 906
  Description of Artificial Sequence: Synthetic polypeptide

SEQ ID NO: 927 - protein, 107 aa, Artificial Sequence; identical to SEQ ID NO: 907
  Description of Artificial Sequence: Synthetic polypeptide

SEQ ID NO: 928 - protein, 106 aa, Artificial Sequence; identical to SEQ ID NO: 908
  Description of Artificial Sequence: Synthetic polypeptide

SEQ ID NO: 929 - protein, 106 aa, Artificial Sequence; identical to SEQ ID NO: 909
  Description of Artificial Sequence: Synthetic polypeptide

What is claimed is:

1. An antigen binding protein that specifically binds and agonizes human CD40 (SEQ ID NO: 1), the antigen binding protein comprising a light chain variable region (VL) and a heavy chain variable region (VH), wherein
the VL and VH are selected from the group consisting of:
a) a VL comprising a CDRL1, a CDRL2, and a CDRL3 selected from the group consisting of SEQ ID NOs: 58, 59, and 60, respectively; and a VH comprising a CDRH1, a CDRH2, and a CDRH3 selected from the group consisting of SEQ ID NOs: 136, 137, and 138, respectively;
b) a VL comprising a CDRL1, a CDRL2, and a CDRL3 selected from the group consisting of SEQ ID NOs: 64, 65, and 66, respectively; and a VH comprising a CDRH1, a CDRH2, and a CDRH3 selected from the group consisting of SEQ ID NOs: 142, 143, and 144, respectively;
c) a VL comprising a CDRL1, a CDRL2, and a CDRL3 selected from the group consisting of SEQ ID NOs: 70, 71, and 72, respectively; and a VH comprising a CDRH1, a CDRH2, and a CDRH3 selected from the group consisting of SEQ ID NOs: 148, 149, and 150, respectively;
d) a VL comprising a CDRL1, a CDRL2, and a CDRL3 selected from the group consisting of SEQ ID NOs: 76, 77, and 78, respectively; and a VH comprising a CDRH1, a CDRH2, and a CDRH3 selected from the group consisting of SEQ ID NOs: 154, 155, and 156, respectively;
e) a VL comprising a CDRL1, a CDRL2, and a CDRL3 selected from the group consisting of SEQ ID NOs: 82, 83, and 84, respectively; and a VH comprising a CDRH1, a CDRH2, and a CDRH3 selected from the group consisting of SEQ ID NOs: 160, 161, and 162, respectively;
f) a VL comprising a CDRL1, a CDRL2, and a CDRL3 selected from the group consisting of SEQ ID NOs: 88, 89, and 90, respectively; and a VH comprising a CDRH1, a CDRH2, and a CDRH3 selected from the group consisting of SEQ ID NOs: 166, 167, and 168, respectively;
g) a VL comprising a CDRL1, a CDRL2, and a CDRL3 selected from the group consisting of SEQ ID NOs: 94, 95, and 96, respectively; and a VH comprising a CDRH1, a CDRH2, and a CDRH3 selected from the group consisting of SEQ ID NOs: 172, 173, and 174, respectively;
h) a VL comprising a CDRL1, a CDRL2, and a CDRL3 selected from the group consisting of SEQ ID NOs: 100, 101, and 102, respectively; and a VH comprising a CDRH1, a CDRH2, and a CDRH3 selected from the group consisting of SEQ ID NOs: 178, 179, and 180, respectively;
i) a VL comprising a CDRL1, a CDRL2, and a CDRL3 selected from the group consisting of SEQ ID NOs: 106, 107, and 108, respectively; and a VH comprising a CDRH1, a CDRH2, and a CDRH3 selected from the group consisting of SEQ ID NOs: 184, 185, and 186, respectively;
j) a VL comprising a CDRL1, a CDRL2, and a CDRL3 selected from the group consisting of SEQ ID NOs: 112, 113, and 114, respectively; and a VH comprising a CDRH1, a CDRH2, and a CDRH3 selected from the group consisting of SEQ ID NOs: 190, 191, and 192, respectively;
k) a VL comprising a CDRL1, a CDRL2, and a CDRL3 selected from the group consisting of SEQ ID NOs: 118, 119, and 120, respectively; and a VH comprising a CDRH1, a CDRH2, and a CDRH3 selected from the group consisting of SEQ ID NOs: 196, 197, and 198, respectively;
l) a VL comprising a CDRL1, a CDRL2, and a CDRL3 selected from the group consisting of SEQ ID NOs: 124, 125, and 126, respectively; and a VH comprising a CDRH1, a CDRH2, and a CDRH3 selected from the group consisting of SEQ ID NOs: 202, 203, and 204, respectively;
m) a VL comprising a CDRL1, a CDRL2, and a CDRL3 selected from the group consisting of SEQ ID NOs: 130, 131, and 132, respectively; and a VH comprising a CDRH1, a CDRH2, and a CDRH3 selected from the group consisting of SEQ ID NOs: 208, 209, and 210, respectively; and
n) a VL comprising a CDRL1 comprising SEQ ID NO:100, a CDRL2 comprising SEQ ID NO:101, and a CDRL3 comprising the CDRL3 of SEQ ID NO: 370; and a VH comprising a CDRH1 comprising SEQ ID NO:178, a CDRH2 comprising SEQ ID NO: 179, and a CDRH3 comprising SEQ ID NO: 180.

2. The antigen binding protein according to claim 1, wherein: the VL and VH are selected from the group consisting of:
a) a VL comprising SEQ ID NO: 5 and a VH comprising SEQ ID NO: 6;
b) a VL comprising SEQ ID NO: 9 and a VH comprising SEQ ID NO: 10;
c) a VL comprising SEQ ID NO: 13 and a VH comprising SEQ ID NO: 14;
d) a VL comprising SEQ ID NO: 17 and a VH comprising SEQ ID NO: 18;
e) a VL comprising SEQ ID NO: 21 and a VH comprising SEQ ID NO: 22;
f) a VL comprising SEQ ID NO: 25 and a VH comprising SEQ ID NO: 26;
g) a VL comprising SEQ ID NO: 29 and a VH comprising SEQ ID NO: 30;

h) a VL comprising SEQ ID NO: 33 and a VH comprising SEQ ID NO: 34;
i) a VL comprising SEQ ID NO: 37 and a VH comprising SEQ ID NO: 38;
j) a VL comprising SEQ ID NO: 41 and a VH comprising SEQ ID NO: 42;
k) a VL comprising SEQ ID NO: 45 and a VH comprising SEQ ID NO: 46;
l) a VL comprising SEQ ID NO: 49 and a VH comprising SEQ ID NO: 50;
m) a VL comprising SEQ ID NO: 53 and a VH comprising SEQ ID NO: 54; and
n) a VL comprising the VL sequence of SEQ ID NO: 370 and a VH comprising SEQ ID NO: 34.

3. The antigen binding protein according to claim 1, wherein the heavy chain comprises an amino acid substitution selected from the group consisting of:
(i) N297G or N297A;
(ii) L234A and L235A; and
(iii) R292C and V302C;
wherein the amino acid numbering is EU numbering according to Kabat.

4. The antigen binding protein according to claim 3, wherein the heavy chain comprises N297G, R292C, and V302C mutations, wherein the amino acid numbering is EU numbering according to Kabat.

5. The antigen binding protein according to claim 1, wherein the antigen binding protein further comprises a light chain constant domain (CL) polypeptide linked to the VL, wherein the CL polypeptide is selected from the group consisting of SEQ ID NO: 883 and SEQ ID NO: 884.

6. The antigen binding protein according to claim 1, wherein the antigen binding protein further comprises a heavy chain CH1-hinge-CH2-CH3 polypeptide wherein the CH1-hinge-CH2-CH3 polypeptide is selected from the group consisting of SEQ ID NO: 885 and SEQ ID NO: 886.

7. The antigen binding protein according to claim 1, wherein said VH comprises a human framework (FR) sequence, and said VL comprises a human framework (FR) sequence.

8. The antigen binding protein according to claim 1, wherein said antigen binding protein comprises a human constant domain.

9. The antigen binding protein according to claim 1, wherein said antigen binding protein comprises a human light chain constant domain (CL).

10. The antigen binding protein according to claim 9, wherein said CL is a kappa CL or lambda CL.

11. The antigen binding protein according to claim 1, wherein said antigen binding protein comprises a human heavy chain constant domain CH1.

12. The antigen binding protein according to claim 11, wherein said CH1 is an IgG CH1.

13. The antigen binding protein according to claim 11, wherein said CH1 is an IgG1 CH1.

14. The antigen binding protein according to claim 1, wherein said antigen binding protein comprises a human heavy chain Fc domain.

15. The antigen binding protein according to claim 14, wherein said Fc is an IgG Fc.

16. The antigen binding protein according to claim 14, wherein said Fc is an IgG1 Fc.

17. The antigen binding protein according to claim 1, comprising a VH and a VL, wherein said VL comprises a CDRL1 comprising SEQ ID NO:100, a CDRL2 comprising SEQ ID NO:101, and a CDRL3 comprising the CDRL3 of SEQ ID NO: 370; and said VH comprises a CDRH1 comprising SEQ ID NO:178, a CDRH2 comprising SEQ ID NO: 179, and a CDRH3 comprising SEQ ID NO: 180.

18. The antigen binding protein according to claim 1, comprising a VH that comprises SEQ ID NO: 34, and a VL that comprises the VL sequence of SEQ ID NO: 370.

19. A fusion protein comprising the VL and VH of claim 1.

20. An antigen binding protein that specifically binds human CD40 (SEQ ID NO: 1), wherein said antigen binding protein comprises:
(i) a light chain variable region (VL) that comprises a CDRL1 comprising SEQ ID NO:100, a CDRL2 comprising SEQ ID NO:101, and a CDRL3 comprising amino acid residues 91 to 101 of SEQ ID NO: 370; and
(ii) a heavy chain variable region (VH) that comprises a CDRH1 comprising SEQ ID NO:178, a CDRH2 comprising SEQ ID NO: 179, and a CDRH3 comprising SEQ ID NO: 180.

21. The antigen binding protein of claim 20, wherein said VL comprises amino acid residues 1 to 112 of SEQ IDNO: 370, and said VH comprises SEQ ID NO:34.

22. The antigen binding protein according to claim 20, wherein the heavy chain comprises an amino acid substitution selected from the group consisting of:
(i) N297G or N297A;
(ii) L234A and L235A; and
(iii) R292C and V302C;
wherein the amino acid numbering is EU numbering according to Kabat.

23. The antigen binding protein according to claim 20, wherein the heavy chain comprises N297G, R292C, and V302C mutations, wherein the amino acid numbering is EU numbering according to Kabat.

24. The antigen binding protein according to claim 20, wherein said VH comprises a human framework (FR) sequence, and said VL comprises a human framework (FR) sequence.

25. The antigen binding protein according to claim 20, wherein said antigen binding protein comprises a human constant domain.

26. The antigen binding protein according to claim 20, wherein said antigen binding protein comprises a human light chain constant domain (CL).

27. The antigen binding protein according to claim 26, wherein said CL is a kappa CL or lambda CL.

28. The antigen binding protein according to claim 20, wherein said antigen binding protein comprises a human heavy chain constant domain CH1.

29. The antigen binding protein according to claim 28, wherein said CH1 is an IgG CH1.

30. The antigen binding protein according to claim 28, wherein said CH1 is an IgG1 CH1.

31. The antigen binding protein according to claim 20, wherein said antigen binding protein comprises a human heavy chain Fc domain.

32. The antigen binding protein according to claim 31, wherein said Fc is an IgG Fc.

33. The antigen binding protein according to claim 31, wherein said Fc is an IgG1 Fc.

34. A fusion protein comprising the VL and VH of claim 20.

35. The fusion protein of claim 34, comprising a heavy chain fusion protein that comprises a Fab fragment, a single-chain FIT (scFv), or both.

* * * * *